(12) United States Patent
Vossen et al.

(10) Patent No.: US 9,551,007 B2
(45) Date of Patent: Jan. 24, 2017

(54) **CLONING AND EXPLOITATION OF A FUNCTIONAL R-GENE FROM *SOLANUM CHACOENSE***

(75) Inventors: Jacobus Hubertus Vossen, Wageningen (NL); Maarten Nijenhuis, Arnhem (NL); Marion Johanna Barbara Arens-De Reuver, Bennekom (NL); Edwin Andries Gerard Van Der Vossen, Utrecht (NL); Evert Jacobsen, Wageningen (NL); Richard Gerardus Franciscus Visser, Bennekom (NL)

(73) Assignee: WAGENINGEN UNIVERSITEIT, Wageningen (NL)

( * ) Notice: Subject to any disclaimer, the term of this patent is extended or adjusted under 35 U.S.C. 154(b) by 0 days.

(21) Appl. No.: 13/496,845

(22) PCT Filed: Sep. 20, 2010

(86) PCT No.: PCT/NL2010/050612
§ 371 (c)(1),
(2), (4) Date: May 30, 2012

(87) PCT Pub. No.: WO2011/034433
PCT Pub. Date: Mar. 24, 2011

(65) Prior Publication Data
US 2012/0240284 A1 Sep. 20, 2012

(30) Foreign Application Priority Data

Sep. 18, 2009 (EP) .................................... 09170769

(51) Int. Cl.
*A01H 5/00* (2006.01)
*A01H 1/00* (2006.01)
*C12N 15/82* (2006.01)
*C07K 14/415* (2006.01)
*C12N 15/00* (2006.01)

(52) U.S. Cl.
CPC ......... *C12N 15/8282* (2013.01); *C07K 14/415* (2013.01)

(58) Field of Classification Search
None
See application file for complete search history.

(56) References Cited

U.S. PATENT DOCUMENTS 7,485,773 B2 * 2/2009 Allefs et al. .................. 800/279

FOREIGN PATENT DOCUMENTS

WO WO-2009/013468 1/2009
WO WO 2009013468 A2 * 1/2009

OTHER PUBLICATIONS

Durr et al. A monoclonal antibody induces opening of a coiled coil. Global protection of amide protons from H/D exchange decreases by up to 1000-fold in antibody-bound triple-stranded coiled coil. 1997. Eur. J. Biochem. 249:325-329.*
Scot. C. Nelson. Late blight of tomato (Phytophthora infestans). 2008. CES CTAHR. PD-45. p. 1-10.*
Jiang et al. Amplification generates modular diversity at an avirulence locus in the pathogen Phytophthora. 2006. Genome Res. 16:827-840.*
Bradeen et al., "Concomitant reiterative BAC walking and fine genetic mapping enable physical map development for the broad-spectrum late blight resistance region, RB," Mol. Gen. Genomics (2003) 269:603-611.
International Search Report for PCT/NL2010/050612, mailed Mar. 2, 2011, 6 pages.
Oberhagemann et al., "A genetic analysis of quantitative resistance to late blight in potato: towards marker-assisted selection," Molecular Breeding (1999) 5:399-415.
Song et al., "Gene RB cloned from Solanum bulbocastanum confers broad spectrum resistance to potato late blight," PNAS (2003) 100(16):9128-9133.
Van Der Vossen et al., "An ancient R gene from the wild potato species *Solanum bulbocastanum* confers broad-spectrum resistance to Phytophthora infestans in cultivated potato and tomato," The Plant Journal (2003) 36:867-882.

* cited by examiner

*Primary Examiner* — Phuong Bui
(74) *Attorney, Agent, or Firm* — Morrison & Foerster LLP

(57) ABSTRACT

The invention relates to a resistance gene and functional homologues or fragments thereof isolated from *S. chacoense, S. berthaultii, S. sucrense* or *S. tarijense*. More over, the invention relates to the use of said resistance gene, for example the use of said resistance gene in a method to increase or confer at least partial resistance in a plant to an oomycete infection. The invention provides an isolated or recombinant nucleic acid sequence comprising a nucleic acid sequence encoding one of the amino acid sequences of FIG 4 or a functional fragment or a functional homologue thereof such as those presented in FIG. 13.

12 Claims, 89 Drawing Sheets

Figure 1A:
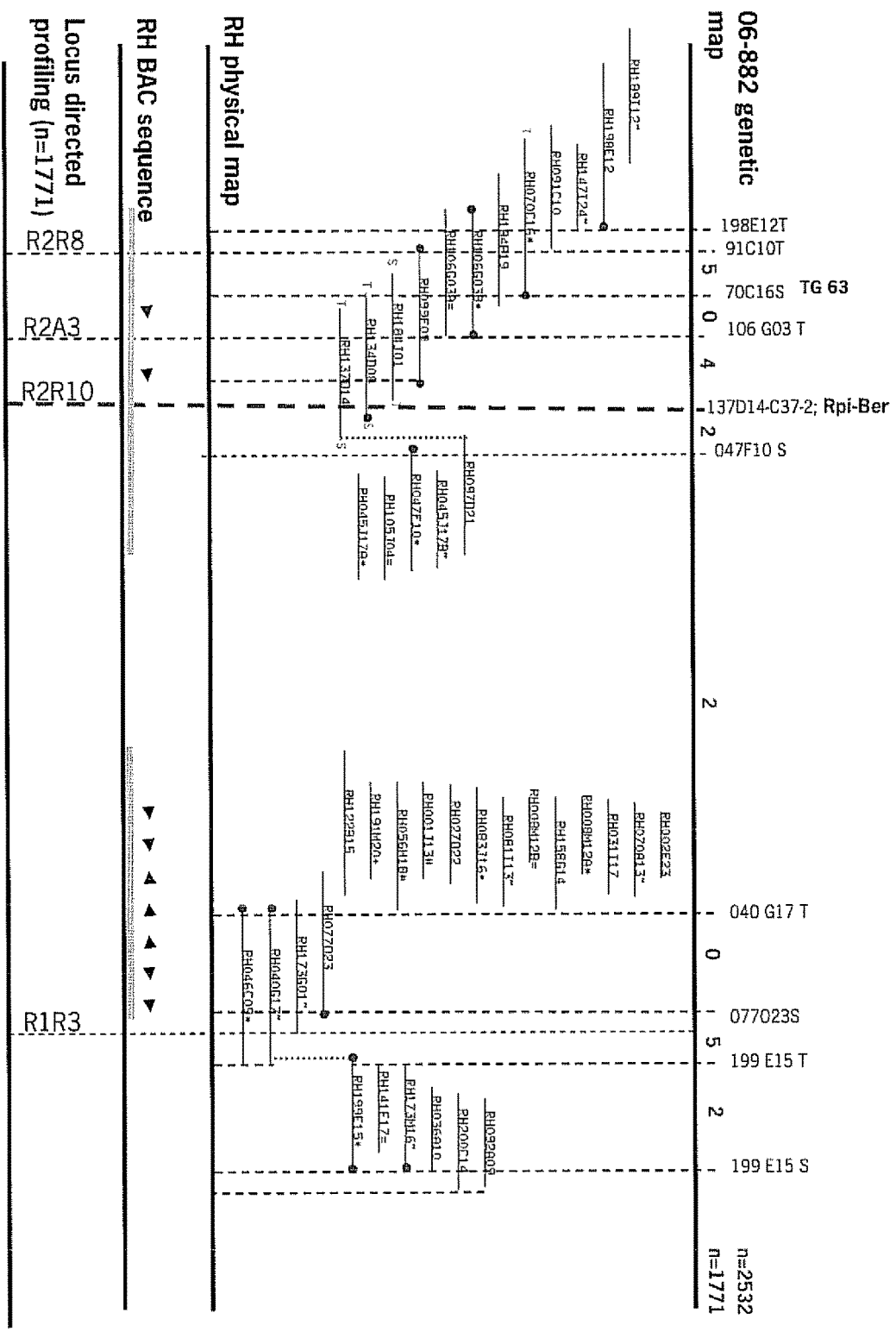

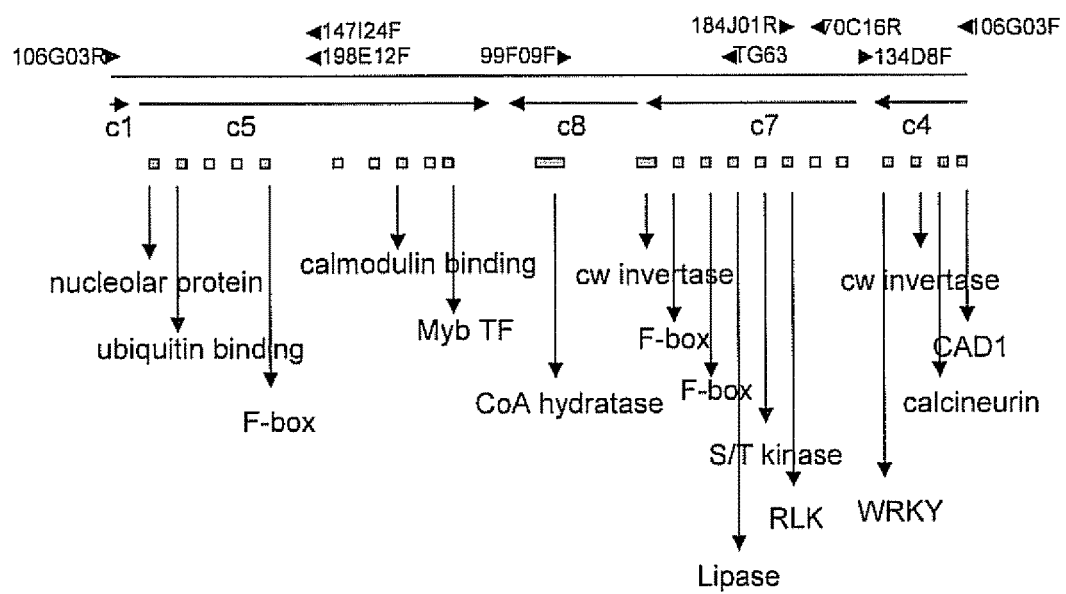
Figure 2A: RH106G03, 131kb

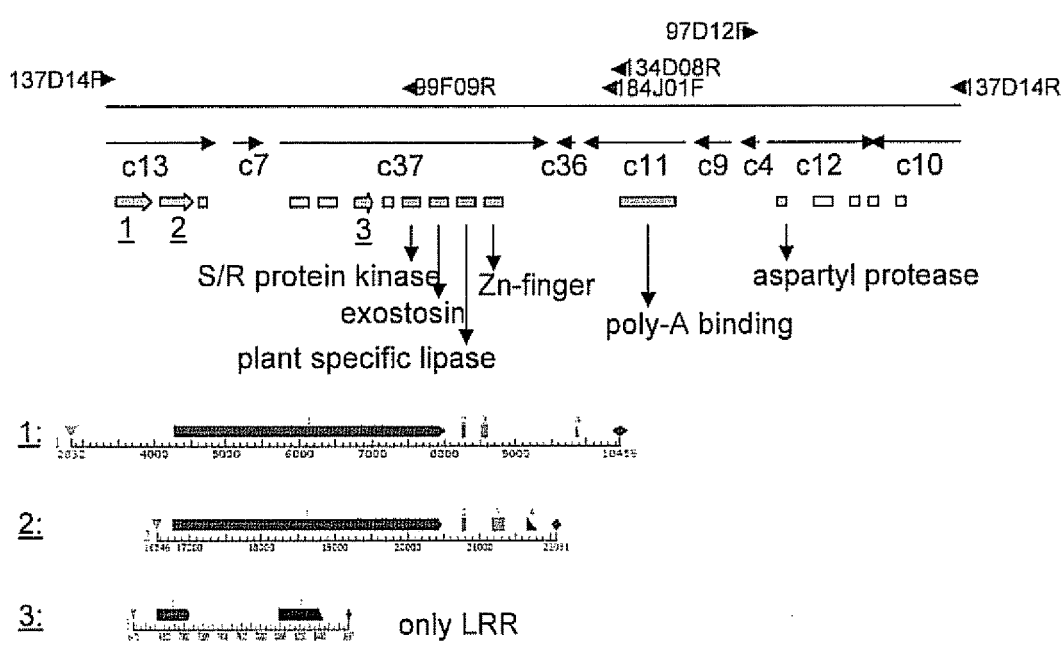
Figure 2B: RH137D14, 129kb

Figure 2C: RH97D21, 135kb
- ▢ NB-LRR
- ▭ predicted function
- ▢ no predicted function
- ▢ transposable element
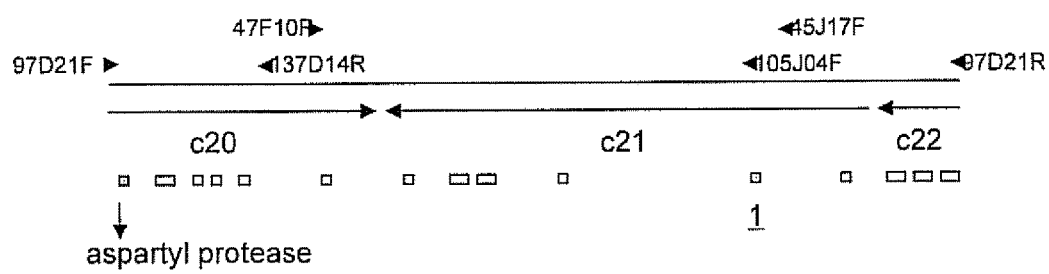
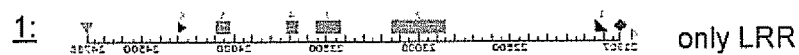 only LRR Figure 2D: RH122B15, 44kb
▭ NB-LRR
▭ predicted function
▭ no predicted function
▭ transposable element
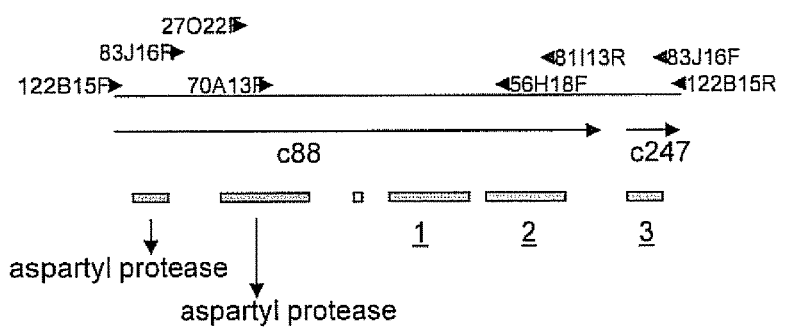
aspartyl protease
aspartyl protease
1:  only LRR
2: 
3: 

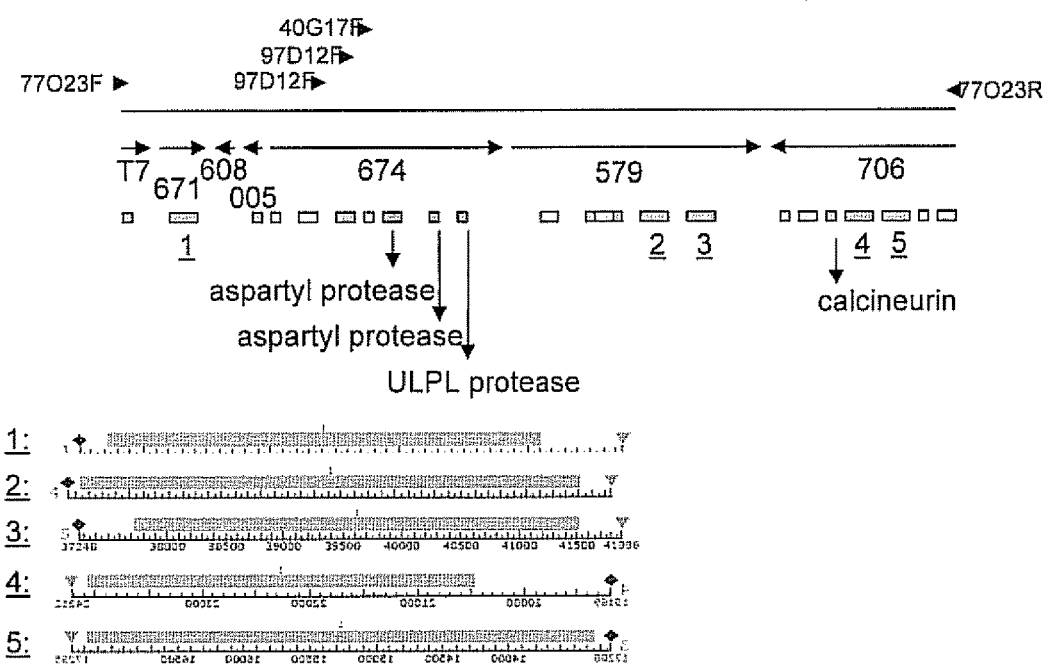
Figure 2E: RH77023, 145kb

Figure 2F: CHC B1 (B07-1-05), 87kb

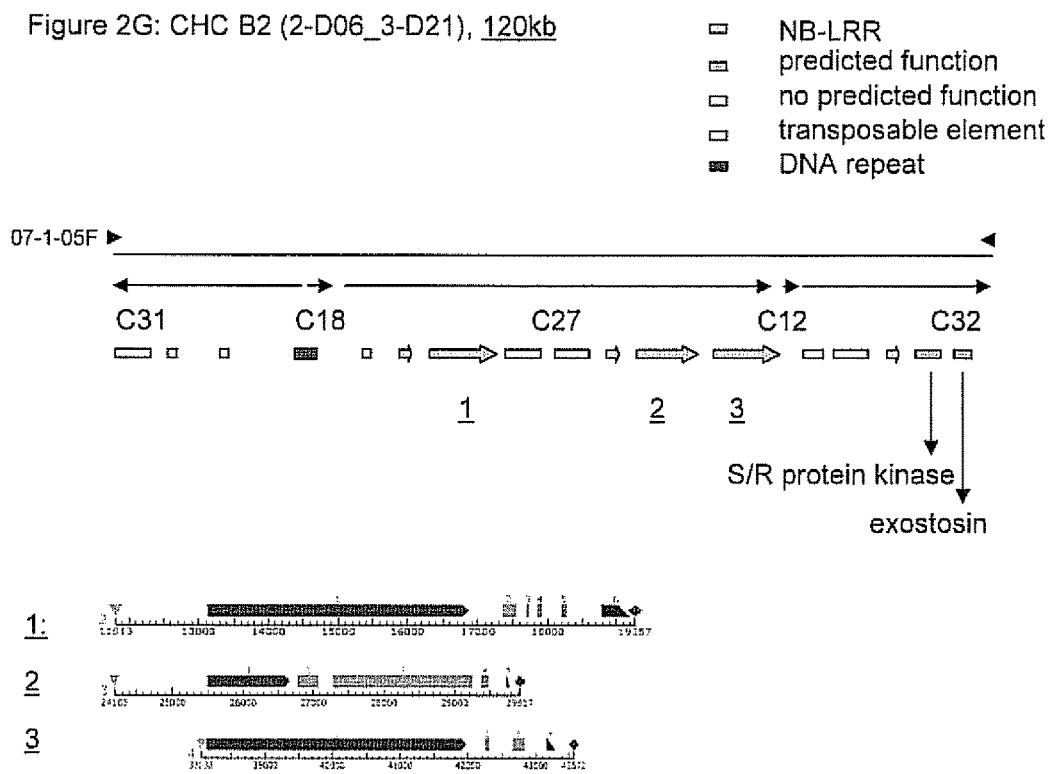
Figure 2G: CHC B2 (2-D06_3-D21), 120kb

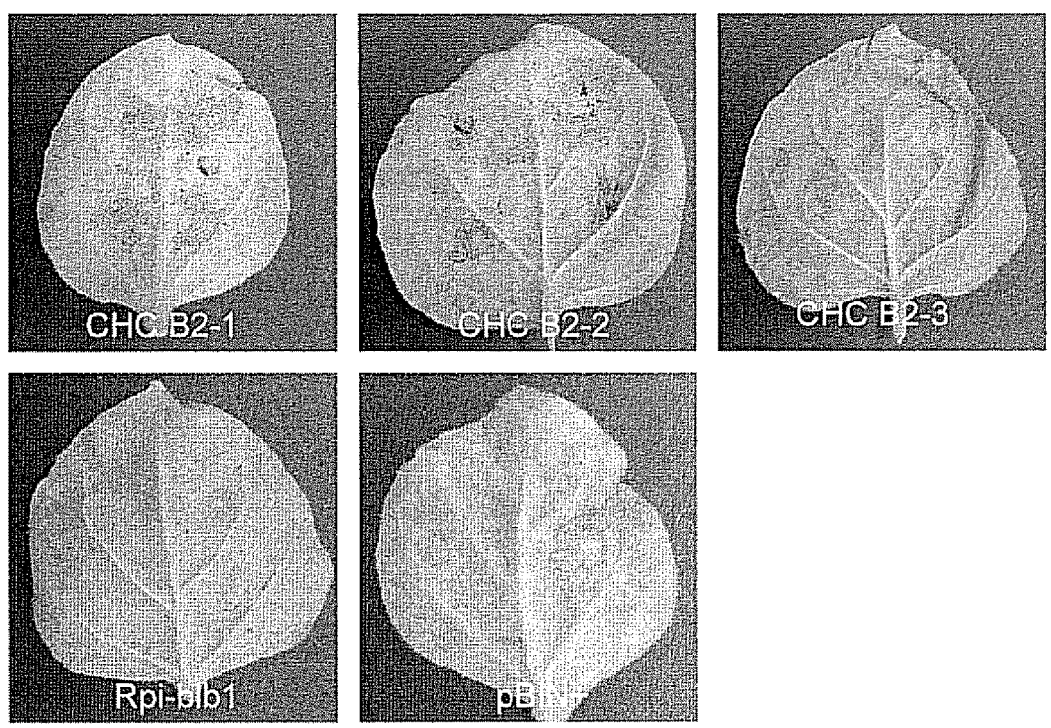
Figure 3: Complementation analysis in *N. benthamiana*

```
77023c5794      ................................................t....
77023c5795      ..................................................
77023c671       ..................................................
77023c7063      ..................................................
77023c7064      ..................................................
122B15C88       ..................................................
122B15C247      ..................................................
CHC_B2-1        ..................................................
CHC_B2-2        ..................................................
CHC_B2-3        ..................................................
CHC_B1-2        ..................................................
CHC_B1-1        HERVASEMRERGHTGTFCISGAFCDLGYTIKVACSAKMVTEQLQQEVTIFGGIKVDLTIDIYASNTTHPYCLKKIISKWQQSY
137D14c131      ..................................................
137D14c132      ..................................................
ABF81421        ..................................................
```

FIG. 4J

FIG. 4K

```
  1  MNYCLPSSTLQTTTKRRLTLRRLCC                    VIGATVQVLLE   60
 61  KLISLTI                      IQAFIHDVETP                  120
121           KTKVVRSPLKKVSGFTSHTAF                            180
181  LQSLMVPSRKILPIRETDSFVVASDIVG                              231

232  TIP              KRIYNDEHMKQIFEKRIWLCLPEMSETKSFLEQILESLIERKIE  291
292  VERRDIIVKKLQDELG           CVDSTSWHEFIDTLRGINTSR        RK  351
352  QVASTVATDLHILGKLTEDHCWSIFKQKAFVDGRVPEELASMGNKIVKM        SVL 411
412  GGLLHNKEKHEWQAILDGNLLVAGEDDNGENSIKKILKLSYDYLPSPHLKK         471
472  KDYMFEKDQLIQLWMAEGFLRPSQEIPVMEDVGHRFFQILLQNSLLQDVLLDEHNNITHC 531
532  K           AGDILKSRLFDPKGDN                             556

557  GEK SQ  RY GCESPTDQIDK                                   578
579   YEPEP CT FWRSNYTSKDM                                    598
599  LN  KF  RV D SSSGIKELSAK                                 621
622  GK  IY  RY D SNTEITALPNS                                 644
645  CK  YN  QT R INCFS QELPYE                                668
669  MRNMIS RH YYTSVDETSGHWGGWCLHNEHFQIPLNMGQ                 708
709   TS QT  KF K GLEKGRQIEELGHLKN                            736
737  RGELT NG Q VCDKEEAQTAYLHDKPN                             765
766  CK AY WSHDESESGCE NDEHVLDG                               791
792   QPHPN KT A VDYLGTKFPSWFSEES                             819
820        PN VK K SGSKRCKEIPS                                839
840  GQ  KF RH  E IGFHE  EC GPAFYGVEMRNIGSNSI                 877
878  QV PS  KK  V KDMRS IEWKGDEVG                             904
905  RMSPG EK  R TDCPL KSIPNQ                                 928
929       EI RQ  K TGVDSEMPLLNLCSN                            952
953       TS VK  R YDMKE TCLPDEM                              974
975  RNNVS QQ  I FNCGE RELPQS                                 998
999   YN RS RR  D YNCTN SSLPVPNG                              1024
1025 DNY TS  EF  C HNCNG ISIPIG                               1048
1049 MLDQCR  VF N SCCNN VSFPVH                                1072
1073  NEMPS SY L SECPK ISVPKVG                                1097
1098  HH TG VR G GPFSEMVDFDAFQLIFNG                           1127
1128  QQ LS RD  E YGRGHWDSLPYQ                                1151
1152  MQ SD RE  T ADFGIEALPPT                                 1174
1175  DN TS ES  T VRCKQ QHLNF                                 1197
1198 SDAMPK RL W RDCPL EALSDG                                 1221
1222  GN VS EE  Y HDCEK EHLPSRDA                              1247
1248 MRR TK WNMR KGCPK EESFTNYSQ                              1274
1275 WSK SH SN  E GGWRRTAISLGFSFTF                            1302
``` lxxlxxlxxlxlxxCxxlxxxP

Figure 5: Protein domain organisation in Rpi-chc1.

The N-terminal CC-domain comprises amino acids 1-231. The amino acids depicted in green shading are predicted to fold into a coiled coil structure using the "coil" algorithm with window size 14. The central domain NB-ARC domain comprises amino acids 232-557. Aminoacids in red shading show similarity to the previously described Kinase 1a, Kinase 2, kinase 3a, GLPL, RNBS-D and MHD domains, respectively. The C-terminal LRR-domain consists of 29 imperfect leucine rich repeats. Conserved hydrophobic aminoacids (A, V, L, and F) are marked by pink shading. The consensus is shown at the bottom.

```
ACGCATCAGGAAGAGAGGAGATTTGTCCCTTTCATTCCCTCTTCTTCATCATCTTTTGTGAGTAGATGT
TCTTTTGCTGGGTTTTGTCTCTACGTTGAAAGAAATCCACTAATGTTACAACAAGTGGAAGAGAATACA
TGATTGTACTGGACTTTTTTTTCCATATATAAATTAAAAAAATGACTCAAACAAATAAAATAAAATTAC
TTGTACAAATCATATATATATATCTATATATATAATAAGCCACAATGCAAATATATATAAAGTATTT
AGTTACATTGTAACTATCTTGTTAGCTTTCAACCAAAAGCTAACAAGATTTTTAGTTACATATTTATTA
TTTAGTTAAATAATAAATATGTCATTGTATGAGCTATTTATTACTCATTCCTTTTGAATTTGTTAATAT
GATTTTGATATGACACATAGTTTACGAAAGTAAATTAGATTTTTAGAAAAAACATTATTTACGAAAGTA
AATTAGATTTTGAGAAAAAACATTAAGTCATACTTGAAGTTGTCCCAGATTTTCAAAAAGCACACCTTAA
CTTTGCGTGCGTCCTATTACCCCACAAAACATTCAAAATCACAATAAATACACATTTTTTACACAATAT
TTTCATTTTGGACAAAAATATCCTTCGAATGTGCAATTTCTTAAAAACAAAAAGTCGGACCCATTATTG
ATGTATTGAAGGATGCTTTGGTCATTTCCTATGATGAATTAGTTTTGTTTGTTTCTTTTAAATTTATTT
TACTATACTAAATAATTGTATAAAATATTCTGAATCACGATAATTAATTACTTAAATATTTAAAAGATA
TAAAAATATATAAAGATCTTATTGACTCTTCAAATTTTACCAGTGACACATAAATTGGGACAAATGAA
ATAATATATATTATTTGAAAATTTCTTAGAAAGTACTATAAATTACAGTAATTAACAGCTAGAAATATT
TCAAAGACAAAAAAATTTGATTGAATCTCAAAATATCTTTTAGTACTACATAAATTGAGAAAGAAGAAA
TAACCTCTATTATTTAAAATGACGTAAAAATATTACAAATCATACAATAAGAATTAACAATTTAAAAC
TTTAAAAGACTTTAATGCTTTATACTTATTCTATTTTCACTTTGGACAAAATATCCTCCCAATATGCA
TATTTTTAAACAAAAAGTGGGACCTATTATTGATGTATTCAAGGATGCTTTGGTAATTTTCCTATGAT
GAATTCGTTTGTTTGTTGTTAATTTTTTTAAAATAATTGTATAAAATATTATAAATCACAATAATT
ATTTACTTAAATATTCAAAAGATATAAAAATATGTAAAAGATCTTATTAACTCTTCAAATTTTATCGGT
GACACATAAATTGGACAAATGAAATAATATATATTATTTGAAAATTACTTAGAAAGTACAATAATTTAC
AGTAATTAACAATAGAATATTTTAAGACAAAAAAATTGATTGAATCTCGAAATTTTATTAGTACCACAT
AAATTGAGAAAGAAGAAATAACCTTTATTATTCAAAATTGCGTAAAAGATATTACAAATCATACAACA
ATAATTAGCAATTTAGAATGTTAAAAGACATAAAAATCTTTTTTACCATAGCTAACAATAATTAAAAAT
TTAAACTATTTTAAATTAATATTAAAGTTTGATTAACACTTTAATTTTGTCTTTGCCACATAAATTGAA
ACAAAAAATGATATATATTGGGCCCGTGCTAGCACGGGCTCCGATGTCTAGTATATATATATATATATA
TATATAGGAGAAACATAGAGAAGGTGATGTGACACCTCTCTATGGCCTCCATTCATATATTTTTTTTTC
CTTTTTTTCTTATTTAAATCAATTATTTTATTGTAAAAGTAAATTGATTAATTTTTGTAAATAAATAT
TTTATTAATAGAGGAACAATTACAACAAAAACTCTTCATATGCCAATTAACAAAGAGTAACTATCTATA
ACTCACACCTCTCTAATTTTCAATTTTAATAAATTTATTTTTATTTGTATCTCTTTTTTACCTTCTTC
TAATCGTAAAATGACAACATTTTTTAAATATCTTCTCTCTTTATTATTTAATTTCTTTACAATCTATC
TATATCGATGTATTTAAGTATTAACGTTTTCAATGCTTATTATGTTGATGCTTTGGATTGACTTGAA
AGAAGATGAAGGCTATTGAATGATGGCTATGGCTTGTGAAAATGGATGTCAATAAAAGCTCAAAAAATT
GTATATTAATTTCATTTTTAAAAATATTTAATAATTAAGAACATAAAAATAATACAATTATTTATTAT
TTTAATTCTTTCATGATTTCTCTTTATCAAACATCAAAAGTTCATTTTATAAATGGATTGCACCTAGAG
TTGCATTTCCCCATCATAAATATGATTATTTTAATCATTTATATGTGTAAGAGCCGTTTTTAAAATTC
TGTATTGCGATTCTAATATTAAAAAAAAAAATTTATAATGTTTTACTGATTTTATAGTAACACTGTA
CTAATGATTTGTTTTTCCTATTCCTGACTATATTAATTACTTTCATATTCTCAAATTAAATGGGATAAT
TAATGGGTAATAATGTTTATACTTCTTCATATTTTATAACATGTTTTTATGCGTGATTTCTGTAATAGC
TTTTCTTATATTTTATGTTGAGACTTTGAAAATATATTTTGGTTATTTATCTTTATTATTGTGAAGTTA
GAAGATGAAAAGGGAATATGATTGGACAATTTTCAAAAGATAATGAGTAATTATGTCGGAAAGTATTTG
AGGAGATTAAGTTAAAAGATTAAAAATAAATATTCATGTTTTAAAATTTAGTAATACATATACTTGAAG
AAAGAATTTGATTTTTCTTGAACTTCTATCCTTTCTTTACATTCTTTTAACAAATATAAAAATATCATT
TCACTTATATAGATTATACATTATACAAGTTTTATAGAGAGGCTCTGAATTTTCAAGTGCTGAAAAATC
ATAGAAAATGTACTAATAATATAATTGATTAGAATATTATACAAGTTTTATGGAAAGGCTCTGAATTTT
TAAGTGCTAAAAATCATAGACTTTACTAATAATATAATTGATTAAATTTAAAATATTTAAGAAAAA
ATCTAATATCAAAATTCATACGCGCGAAGCGCTAAAGTTCTCTTGTAAAAATGTAAATAGAACTGC
TTGTACAAATAAAACAAAAAGCTACTTAAATACAAATTAATATAAAGGGAAAAAGAGACTCAAACTTGGTT
TCATCCACATGTATTTTTTTTTATTACTGTTTGAATGATTGTATATGAATTATTGTCTTCCTTCGAGT
ACTCTACAAACAACTACCAAACGAAGACTTACTTTGAGAAGACTTTGTTGCAAACAGCTCAGGAAGAAG
AGTTTGGTGCAGACTGCAGAGGAAGACGAAGCCAAACACAACAATGGCCGATCCTGTAATTGGTGCTACT
GTTCAAGTTTTGCTTGAAAAGTTGATTTCTCTCACTATCGAGGAAGTCAACAGCTCAAGGGATTTCAAC
AAAGATCTCGAAATGTTGCACAAAATGTATCTTTAATCCAAGCTTTCATTCATGATGTTGAAACACCA
CAAGAGAAACAACAGTCTGTGGAACAATGGCTCAACAGGCTTGAGAGAGTTGCTGAAGATGCTCAAAAT
GTGTTTGATCGATTCATATATGAATCTCTCAAAACAAAAGTGGTGAGGAGCCCATTGAAAAGGTCAGT
GGTTTCTTTTCTCATACTGCTTTTAAGAGAAAAATGTCTCAAAAAATCAACAACATCAATAAAGAGTTG
```

FIG. 7A

```
ACGGCTATCAATAAGGTAGCCAAAGACGTCGGTCTACAATCACTCATGGTTCCTTCTCGGAAAATACTA
CCAATTCGAGAAACAGATTCCTTTGTAGTTGCTTCTGATATTGTCGGTACAGATTTGCATATTGCTGAG
ATAAAGGAGAAGATTTTGAACATGAGAGAGGAGGATATTGTTCTGTCGACCATTCCCATAGTAGGTATG
GGAGGTTTAGGGAAAACAACTGTGGCTAAGAGGATTTACAATGATGAACACATGAAGCAAATCTTTGAA
AAGAGAATTTGGTTGTGTCTACCTGAAATGTCTGAAACGAAGAGCTTTCTTGAACAAATCCTCGAATCG
TTGATAGAGAGGAAAATTGAGGTTGAAAGGAGAGATATAATAGTCAAGAAGCTACAAGATGAATTCGGA
GGAAAAAAATATTTGCTAGTCCTGGATGATTTGTGGTGTGTTGACTCTACATCGTGGCATGAGTTCATT
GACACGTTGAGAGGAATAAATACATCCAGAGGAAACTGCATTCTTGTGACTACTCGTAGGAAGCAGGTG
GCATCCACAGTAGCAACAGATCTTCATATCTTGGGGAAGTTAACAGAAGATCATTGTTGGTCTATTTTC
AAACAAAAACCATTTGTCATGCCACAGGGTTCCAGAGGAATTAGCGAGCATGGGCAACAAGATTGTTAAA
ATGTGCCAAGGTCTACCGTTGGCGTGCAAGTGTGTTGGCAGGGCTCTTACACAACAAAGAAAAACATGAA
TGGCAAGCAATTCTTGATGGCAACCTCCTTGTTGCAGGTGAAGATGATAATGGAGAAAATAGCATAAAG
AAAATCCTAAAACTCAGCTATGATTATCTACCATCTCCACATCTGAAAAAATGCTTTGCTTACTTTGCA
ATGTTTCCAAAAGATTATATGTTTGAAAAGGACCAACTAATCCAAGTCTGGATGGCAGAAGGGTTTCTT
CGTCCAAGTCAAGAGATCCCTGTGATGCAAGACGTTGGGCACACGTTTTTTTCAAATCTTCTTGCACAAT
TCCTTGCTACAAGATGTTCTGTTAGATGAACACAACAATATAACACACTGCAAGATGCACGATCTTGTG
CATGATTTGGCTGGAGATATCTTAAAATCTAGACTATTTGATCCGAAGGGCGACAATGGAGAAAACTTT
TCTCAAGTTCGATACTTTGGATGTGAGTCACCAACGGATCAAATAGATAAGATATATGAGCCAGAACGT
TTGTGCACACTGTTTTGGAGAAGCAATTATACATCTAAAGATATGCTGTTGAACTTTAAGTTCTTGAGA
GTTTTAGATTTGTCCAGTTCAGGAATCAAGGAGTTGTCAGCCAAAATCGGGAGCGTGATATACTTGAGA
TATCTTGATCTCTCGAACACTGAGATCACAGACCTTGCCCAACTCCATTTGCAAGCTCTATAATTTGCAA
ACATTTAGAGTCATCAACTGCTTTTCACTCCAGGAACTTCCATATGAGATGAGAAATATGATAAGTTTG
AGACACATATATTACACTTCTGTTGACGAAACAAGTGGGCATTGGGGAGGATGGTGTCTTCACAATGAA
CATTTTCAGATTCCACTTAATATGGGGCAATTGACTAGTCTTCAAACCCTCAAGTTTTTCAAGGTAGGT
TTAGAGAAAGGTCGTCAAATAGAAGAATTAGGTCATTTGAAAAAACCTAAGAGGTGAATTGACGATCAAT
GGTCTCCAATTGGTCTGTGATAAAGAAGAGGCTCAAACAGCATATTTACACGATAAACCAAACATCTGC
AAGCTGGCATATTTATGGTCGCATGATGAATCACAAGGCTGTGAGATCAATGATCAGCATGTGTTGGAT
GGTCTTCAACCGCATCCTAACTTGAAAAGCCTTAGCAGTAGTGGACTATTTAGGGACTAAATTTCCTTCA
TGGTTCAGTGAAGAGTGGCTACCAAATTTGGTCAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGC
ATTGGACCTCGCTTTTTATGGTGTTGAGATGCAAATATTGGATCAAACACGGCATTATCCAAGTGTTCCCG
TCATTGAAAAAAACTAGTATTGAAGGATATGCGTAGCCTTATTGAGTCGGAAGGGAGATGAAGTTGGAGTA
AGAATGTCTCCCGGTCTTGAGAAGTTGGGGATTACAGACTGTCCATTGTTAAAAAGTATTCCGAATCGA
TTTGAAATCCTCCGTCAATTAAAAATTACAGGACTTGACAGTGAAATGCCATTGTTGAACTTGTGCAGC
AACTTGACATCTCTCGTAAAGCTTAGAGTCTATGATATGAAAGAGCTCACTTGTCTTCCAGATGAGATG
CTACGTAACAACGTTTCTCTTCAACAGATAATAATTTTCAACTGCGGAGAGTTTCGTGAATTGCCACAA
AGGTTGTACAATCTCCATTCTCTTAGGAGATTAGACATTTACAACTGCACCAATTTCAGTTCTCTTCCT
GTTCCAATGGAGACAACTATTTGACTTCCCTCGAATTCTTTTGCTTACATAATTGTAATGGATTGATC
ACTATACCAATTCCAATGCTAGATCAATGCCGGCTAGTGTTTTTGAATGCTAATATCAGCTGCTGTAACAACTTG
GTTTCATTCCCTGTACATGTGTGGGAAATGCCTTCACTTTCATATTTGCTTATATCAGAATGTCCCAAA
TTGATTAGTGTACCCAAAGTGGGCCTTCACCATCTCACCGGGTTAGTGAGATTGGGAATTGGTCCTTTC
TGAGAGATGGTGGATTTTGATGCATTCCAATTGATTTTTAATGGCATTCAGCAGTTGTTGTCCCTTCGT
GATCTGGAGGTGTACGGACGTGGGCACTGGGATTCTCTGCCCTATCAGCTTATGCAACTCTCTGACCTA
AGAGAGATCACAATAGCTGATTTCGGAATTGAGGCTCTTCCTCCTACTCTTGACAAGCTTACTTCTCTT
GAAAGTTTGACGCTAGTGAGGTGCAAACAGCTACAACATCTGAACTTCTCAGATGCCATGCCCAAATTA
CGGCTCCTGTGGATACGTGATTGTCCATTGTTAGAAGCTCTGTCGGATGGGCTGGCAAGCTTGTTTCT
TTGGAAGAATTATATTTACATGACTGCGAAAAACTAGAGCATCTACCGTCCGAGATGCCATGCGACGC
CTCACTAAATTATGGAACATGAGAATTAAAGGATGCCCAAAGTTACAAGAAAGTTTCACCAACTACTCC
CAGTGGTCCAAAATTTCCCATATTTCAAATATTGAATTAGGTGGGTGGACAAGGACAGCCATAAGTCTC
GGTTTCTCTTTCACTTTCTGAGTCGCTTGCATTTTTAATTAGAATATTATTTTCCACGAGTTCCAAAAA
AGAAGTTTTGTAAGTAATGTAATAATTTTTCTTGAAATTATTTTGACATAAAAAAAAAGCTAGATTAT
CAATCAATTGCATCTGTTGCTATGCTTTCAGGATTCTGCTTGTCCACTTGAACTGAATTGCTGTTATTC
TAAAAATTATGTTTCTTTTCCTTATAGATAGCCATTATAGACGTCTCTGTGGTAAATCAAGCCAAATCA
TATGAGCAGCAGGCAATTACGTAAGGTAAATTTTCATTTATAATTTATAGGCACTTTGTAATCTACTTG
TTTCTATCTTTCTTTTTGTTGGAAACCAATTTTTGGAGGTCTATGCTGATGAATACAACATTACCTTCC
TTAAAAAAAGTTTAATCATGAAAATTTATGATTTCTGCTCATAGGTTACTAGGTACAAGGACATGGTA
GAACATCGTTGTGGTATATCTAGTCAAAATCCATGGGCAGAATCATGTTAGGCATTTTTATTTAGTTGT
TAGAGGAATGCTATAACAAGTTTGTAAAGTTTCTCTTTTTTACTTTCCTTTTCTCTCATGAAATAATT
TTAATGTTTAACGGGACTTGTCGTGTTTCACAGAGGAACCG
```

FIG. 7B

Figure 10
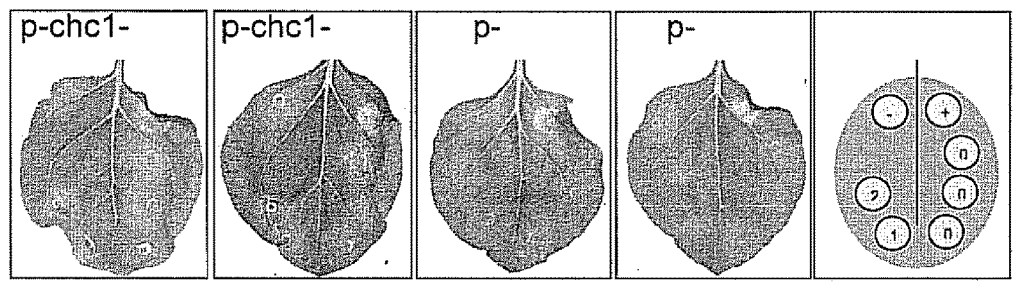
Figure 11
A. 
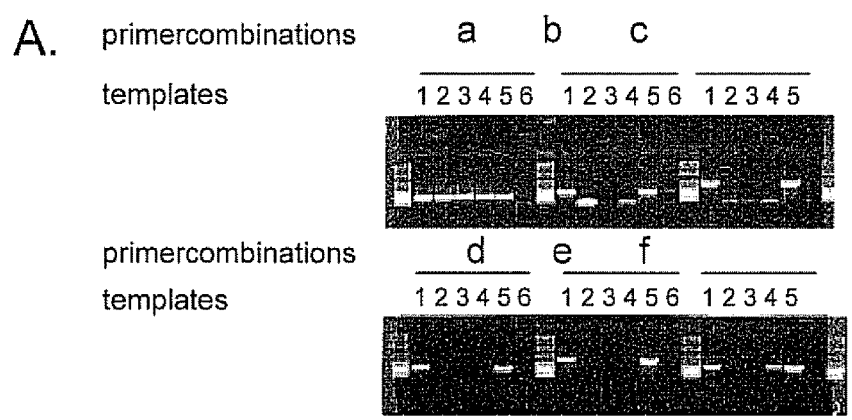
B.
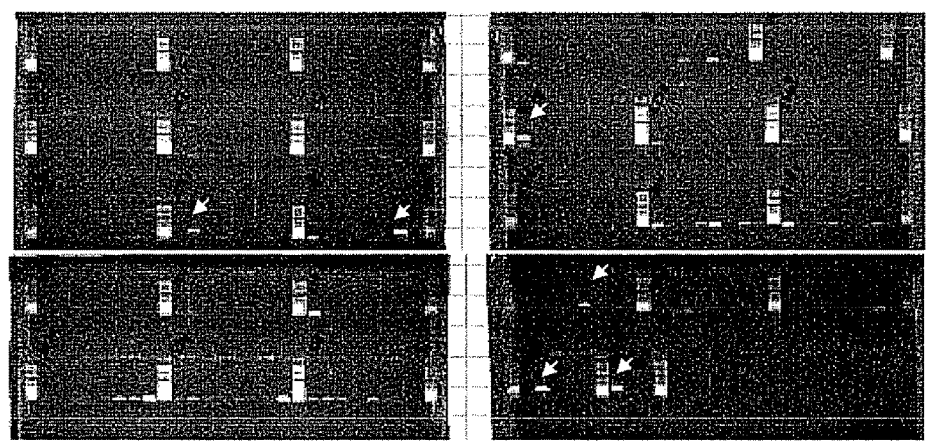

Figure 12

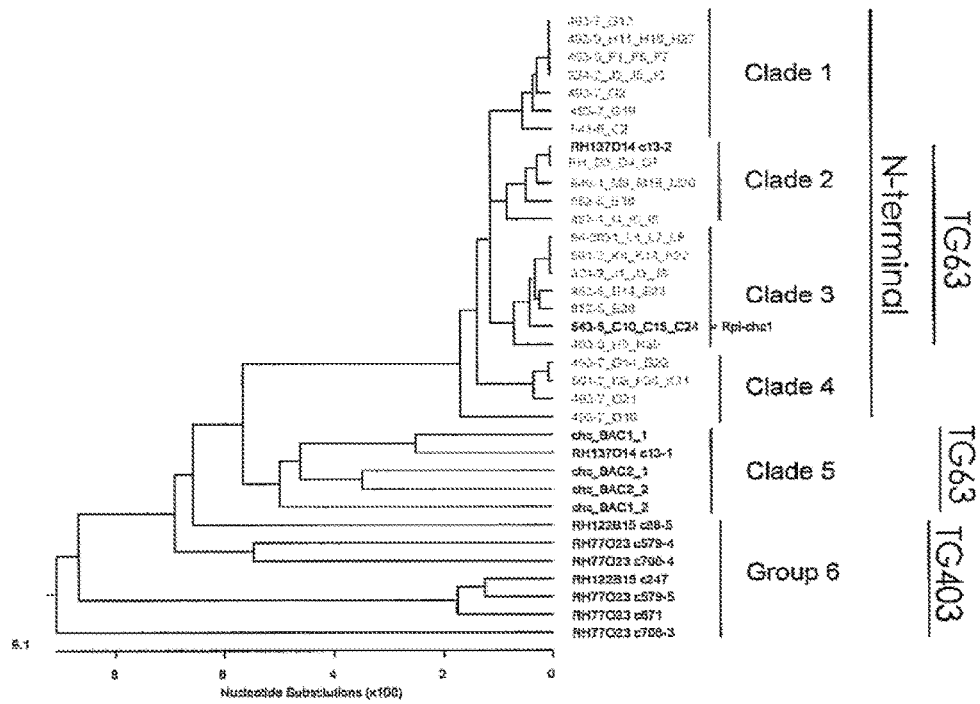

>493-7_G12
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT
TGGTGCTACTGTTCAAGTTTTTGCTTGAAAAGTTGATTTCTCTCACTATCGAGGAGGTCAACAGCTCAAGGGATTTC
AACAAAGATCTCGAAGTGTTGACACAAAATGTATCTTTAATCCAAGCTTTCATTCATGATGTTGAAACACCACAAG
AGAAACAACAGTCTGTCGAACACTGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAGGTCAGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATGGTACCTTCTCGGAAAATACTACCAATTCGAGAAACAGATTCCTTCGTAGGTGC
TTCTGATGTTGTTGGTAGAGATTTAGATGTTGCTGAGATAAAGGAGAAGATTTTGAAGATGAGAGGAGGATGTT
GTTCTGTCCACCATTCCCATAGTAGGTATGGGAGGTTTAGGGAAAACAACTGTGGCTAAGAGGATTTACAATGATG
AACACATCAAGCAAATCTTTAAAGAGAGAATTTGGTTGTGTATACCTGAAATGTCTGAAACGAAGAGCTTTCTTGA
ACAAATCCTCGAATCGTTGATAGAGAGGAAATTGAGGTTGAAGGAGAGATATAATAGTCAAGAAGCTACAAGAT
GAATTGGCAGGAAAAAAATATTTGCTAGTCCTGGATGATTTGTGGCGTGTTGACTCTACATCGTGGCATGAGTTCG
TCGACACCCTGAGAGGAATAAATACATCCAGAGGAAACTGCATTCTTGTGACTACTCGTATGAAGCGGGTGGCATC
CACAGTAGCAACAGATCTTCATATCTTGGGAAGTTAACGAAGATCATTGTTGGTCTATTTTCAAACAAAAGCA
TTTGTTGATGGCAGGGTTCCAGAGGAATTAGCGAGCATGGGCAACAATATTGTTAAAATGTGCCAAGGTCTACCGT
TGGCTGCAAGTGCATTGGGAGGGCTCTTACACAACAAAGAAAAACATGAATGGCAAGCAATTCTTGATGGCAACCT
CCTTGTTGCAGGTGAAGATGATAATGGAGAAATAGCATAAGAAAATCCTAAAACTCAGCTATGATTATCTACCA
TCTCCACATCTGAAACAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAgAATTCCTGCTACAAGATGTTGTGTTAgATGAACACAACAATATAACACACTGTAAG
ATGCACGATCTTGTGCATGATTTGGCTGGAGATATCTTTAAAATCTAGACTATTTGATCCGAAGGCGCACAATGGAG
AAAAACTTTCTCAAGTTCGATACTTTGGATGTGAGTCACCAAAGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCGAGCTCTATAATTTGCAAACATTTAGAGTCATCAACTG

FIG. 13A

CTTTTCACTCCAGGGACTTCCATATGAGATGAGAAATATGATAAGTTTGAGACACATATATTACACTTCTATTGAC
GAAACAAGTGGGCATTGGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAGGAGGTGAATTGACAATCAATGGTCTCCAATTGGTCTGTGATAAAGAAGAGGCTCGAACAGCATATTTA
CACGATAAACCAAACATCTGCAAGCTGGCATATTTATGGTCCCATGATGAATCAGAAGGCTGTGTGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGGTTAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTATATGGTGTTGAGATTAGAAATACCGGATCAAACAGCAATATCCAAGTGTTCCCGTCATTGAAAGAACT
AGTATTGGAGGATATGCGTAGCCTTATTGAGTGGAAGGGAGATGAAGTCGGAGTAAGATGTCTCCCGGGCTTGAG
AAGTTGCGGATTACAGACTGTCCATTGTTAAAAAGTATTCCAAATCAATTTGAAATCCTCTGTGAATTAGAAATTA
GAGGAGTTGACAGTGAAATGCCATTGTTGAACTTGTGCAGCAACTTGACATCTCTCGTAAAGCTTAGTGTCTATGA
TATGAATGAGCTCACTTGTCTTCCAGATGAGATACTACGTAACAACGTTTCTCTTCAACAGATAACGATTTTCAAC
TGTGGAGAGTTTCGTGAATTGCCACACAAAGCTTGTACAATCTCCATTCTCTTAAGAGATTAGACATTTACAACTGCA
CCAACTTCAGTTCTCTTCCTGTTCCCAATGGAGACAACTATTTGACTTCCCTCGAATTCTTTTCTTATATAATTG
TAATGGATTGATCAGTATACCAATTGGAATGCTAGATCAATGCCGGTCTCTAGAGTTTTTGCATGTCAGCTGCTGT
AACAACTTGGTTTCATTCCCTTTACATGTGTGGGAAATGCCTTCATTTTCATTTTTGGATATAAGAGAATGTCCCA
AATTGATTAGTGTACCCAAAGTGGGCCTTCACCATCTCACCGGGTTATTGAGTTTGGGAATTGGTCCTTTCTCAGA
GATGGTGGATTTTGATGCATTCCAATTGATTTTTAATGGCATTCAGCAGTTGTTGTCCCTTCGTGATCTGGAGGTG
TACGGACGTGGGCACTGGGATTCTCTGCCCTATCAGCTTATGCAACTCTCTAACCTAAGAGAGATCACAATAGCTG
ATTTCGGAATTGAGGCTCTTCCTCCTAGACTTGACAACCTTACTTCTCTTGAAAGTTTGACGCTAGACAGGTGCAA
ACGGCTACAACATCTGAACTTCTCAGATGCCATGCCCAAATTACGGCTTCTGTGGATAAGTGATTGTCCATTGGTA
GAAGCTCTGTCGGATGGGCTCGGCAACCTTGTTTCTTTGGAAGAATTATATTTACAGGACTGCGAAAAACTAGAGC
TTCTACCGTCCCGAGATGCCATGCGACGCCTCACTAAATTATGGAACATGGGAATTAAAGGATGCCCAAAGTTAGA
AGAAAGTTTCACCAACTACTCCCAGTGGTCCAAAATTTCCCATATTTCAAATATTGAATTAGGTGGGTGGAGAAGG
ACAGCCATAAGTCTCGGTTTCTCTTTCACTTTCTGA

>493-9_H11_H19_H27
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACACTGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAAGGTCAGTGGTTTCTTTCTCATACT
GCTTTTAAGAGAAAAATGTCTCAAAAAATCAACAACATCAATAGAGTTGACGGCTATCAATAAGGTAGCCAAAG
ACCTCGGTCTACAATCACTCATGGTACCTTCTCGGAAAATACTACCAATTCGAGAACAGATTCCTTCGTAGGTGC
TTCTGATGTTGTTGGTAGAGATTTAGATGTTGCTGAGATAAAGGAGAAGATTTTGAAGATGAGAGGAGGATGTT
GTTCTGTCCACCATTCCCATAGTAGGTATGGGAGGTTTAGGGAAAACAACTGTGGCTAAGAGGATTTACAATGATG
AACACATCAAGCAAATCTTTAAAGAGAGAATTTGGTTGTGTATACCTGAAATGTCTGAAACGAAGAGCTTTCTTGA
ACAAATCCTCGAATCGTTGATAGAGACGAAAATTGAGGTTGAAAGGAGAGATATAATAGTCAAGAAGCTACAAGAT
GAATTGGGAGGAAAAAAATATTTGCTAGTCCTGGATGATTGTGGCGTGTTGACTCTACATCGTGGCATGAGTTCG
TCGACACCCTGAGAGGAATAAATACATCCAGAGGAAACTGCATTCTTGTGACTACTCGTATGAAGCGGGTGGCATC
CACAGTAGCAACATCACTTCATATCTTGGGGAAGTTAACACGAACATCATTGTTGGTCTATTTTCAAACAAAAGCA
TTTGTTGATGGCAGGGTTCCAGAGGAATTAGCGAGCATGGGCAACAATATTGTTAAAATGTGCCAAGGTCTACCGT
TGGCTGCAAGTGCATTGGGAGGGCTCTTACAACAACAAAGAAAAACATGAATGGCAAGCAATTCTTGATGGCAACCT
CCTTGTTGCAGGTGAAGATGATAATGGAGAAAATAGCATAAAGAAAATCCTAAAACTCAGCTATGATTATCTACCA
TCTCCACATCTGAAACAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGTTGTGTTAGATGAACACAACAATATAACACACTGTAAG
ATGCAGATCTTGTGCATGATTTGGCTGGAGATATCTTAAATCTCAATGCTATTTGATCCGAAGCCGACAATGGAG
AAAAACTTTCTCAAGTTCGATACTTTGGATGTGAGTCACCAAAGGATCAAATAGATAAGATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGACATCACAGCCTTGCCCAACTTCCATTGCGAGCTCTATAATTTGCAAACATTTAGAGTCATCAACTG
CTTTTCACTCCAGGGACTTCCATATGAGATGAGAAATATGATAAGTTTGAGACACATATATTACACTTCTATTGAC
GAAACAAGTGGGCATTGGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAGGAGGTGAATTGACAATCAATGGTCTCCAATTGGTCTGTGATAAAGAAGAGGCTCGAACAGCATATTTA
CACGATAAACCAAACATCTGCAAGCTGGCATATTTATGGTCCCATGATGAATCAGAAGGCTGTGTGATCAATGATG
AGCATGTGTTGGATGGTCTTCAACCGCATCCTAACTTGAAAACCTTAGCAGTAGTGGACTATTTACGGACTAAATT
TCCTTCATGGTTCAGTGAAGAGTCGCTACCAAATTTGGTTAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTATATGGTGTTGAGATTAGAAATACCGGATCAAACAGCAATATCCAAGTGTTCCCGTCATTGAAAGAACT
AGTATTGGAGGATATGCGTAGCCTTATTGAGTGGAAGGGAGATGAAGTCGGAGTAAGATGTCTCCCGGGCTTGAG

FIG. 13B

```
AAGTTGCGGATTACAGACTGTCCATTGTTAAAAGTATTCCAAATCAATTTGAAATCCTCTGTGAATTAGAAATTA
GAGGAGTTGACAGTGAAATGCCATTGTTGAACTTGTGCAGCAACTTGACATCTCTCGTAAAGCTTAGTGTCTATGA
TATGAATGAGCTCACTTGTCTTCCAGATGAGATACTACGTAACAACGTTTCTCTTCAACAGATAACGATTTTCAAC
TGTGGAGAGTTTCGTGAATTGCCACAAAGCTTGTACAATCTCCATTCTCTTAAGAGATTAGACATTTACAACTGCA
CCAACTTCAGTTCTCTTCCTGTTCCCAATGGAGACAACTATTTGACTTCCCTCGAATTCTTTTTCTTATATAATTG
TAATGGATTGATCAGTATACCAATTGGAATGCTAGATCAATGCCGGTCTCTAGAGTTTTTGCATGTCAGCTGCTGT
AACAACTTGGTTTCATTCCCTTTACATGTGTGGGAAATGCCTTCATTTTCATTTTTGGATATAAGAGAATGTCCCA
AATTGATTAGTGTACCCAAAGTGGGCCTTCACCATCTCACCGGGTTATTGAGTTTGGGAATTGGTCCTTTCTCAGA
GATGGTGGATTTTGATGCATTCCAATTGATTTTTAATGGCATTCAGCAGTTGTTGTCCCTTCGTGATCTGGAGGTG
TACGGACGTGGGCACTGGGATTCTCTGCCCTATCAGCTTATGCAACTCTCTAACCTAAGAGAGATCACAATAGCTG
ATTTCGGAATTGAGGCTCTTCCTCCTAGACTTGACAACCTTACTTCTCTTGAAAGTTTGACGCTAGACAGGTGCAA
ACGGCTACAACATCTGAACTTCTCAGATGCCATGCCCAAATTACGGCTTCTGTGGATAAGTGATTGTCCATTGGTA
GAAGCTCTGTCGGATGGGCTCGGCAACCTTGTTTCTTTGGAAGAATTATATTTACAGGACTGCGAAAAACTAGAGC
TTCTACCGTCCCGAGATGCCATGCGACGCCTCACTAAATTATGGAACATGGGAATTAAAGGATGCCCAAAGTTAGA
AGAAAGTTTCACCAACTACTCCCAGTGGTCCAAAATTTCCCATATTTCAAATATTGAATTAGGTGGGTGGAGAAGG
ACAGCCATAAGTCTCGGTTTCTCTTTCACTTTCTGA

>493-5_F1_F5_F7
ATGAATTATTGTCTTCCTTCGAGTACTCTACAAaCAaCTACCAAACGAAGAcTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACACTGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAAGGTCAGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATGGTACCTTCTCGGAAAATACTACCAATTCGAGAAACAGATTCCTTCGTAGGTGC
TTCTGATGTTGTTGGTAGAGATTTAGATGTTGCTGAGATAAAGGAGAAGATTTTGAAGATGAGAGAGGAGGATGTT
GTTCTGTCCACCATTCCCATAGTAGGTATGGGAGGTTTAGGGAAAACAACTGTGGCTAAGAGGATTTACAATGATG
AACACATCAAGCAAATCTTTAAAGAGAGAATTTGGTTGTGTATACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
GAATTGGGAGGAAAAAAATATTTGCTAGTCCTGGATGATTTGTGGCGTGTTGACTCTACATCGTGGCATGAGTTCG
TCGACACCCTGAGAGGGAATAAATACATCCAGAGGAAACTGCATTCTTGTGAcTACTCGTATGAAGCGGGTGGCATC
CACAGTAGCAACAGATCTTCATATCTTGGGGAAGTTAACAGAAGATCATTGTTGGTCTATTTTCAAACAAAAAGCA
TTTGTTGATGGCAGGGTTCCAGAGGAATTAGCGAGCATGGGCAACAATATTGTTAAAATGTGCCAAGGTCTACCGT
TGGCTGCAAGTGCATTGGGAGGGCTCTTACACAACAAAGAAAAACATGAATGGCAAGCAATTCTTGATGGCAACCT
CCTTGTTGCAGGTGAAGATGATAATGGAGAAAATAGCATAAAGAAAATCCTAAAACTCAGCTATGATTATCTACCA
TCTCCACATCTGAAACAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGTTGTGTTAGATGAACACAACAATATAACACACTGTAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAAAGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCGAGCTCTATAATTTGCAAACATTTAGAGTCATCAACTG
CTTTTCACTCCAGGGACTTCCATATGAGATGAGAAATATGATAAGTTTGAGACACATATATTACACTTCTATTGAC
GAAACAAGTGGGCATTGGGGAGGATGTGTCTTCACAATGAACATTTTCAGATTCCACTTAATATGGGCAATTGA
CTAGTCTTCAAACCCTCAAGTTTTTCAAGGTAGGTTTAGAGAAAGGTCGTCAAATAGAAGAATTGGGTCATTTGAA
AAACCTAGGAGGTGAATTGACAATCAATGGTCTCCAATTGGTCTGTGATAAAGAAGAGGCTCGAACAGCATATTTA
CACGATAAACCAAACATCTGCAAGCTGGCATATATTTATGGTCCCATGATGAATCAGAAGGCTGTGTGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGGTTAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTATATGGTGTTGAGATTAGAAATACCGGATCAAACAGCAATATCCAAGTGTTCCCGTCATTGAAAGAACT
AGTATTGGAGATATGCGTAGCCTTATTGAGTGGAAGGAGATGAAGTCGGAGTAAGAATGTCTCCCGGGCTTGAG
AAGTTGCGGATTACAGACTGTCCATTGTTAAAAGTATTCCAAATCAATTTGAAATCCTCTGTGAATTAGAAATTA
GAGGAGTTGACAGTGAAATGCCATTGTTGAACTTGTGCAGCAACTTGACATCTCTCGTAAAGCTTAGTGTCTATGA
TATGAATGAGCTCACTTGTCTTCCAGATGAGATACTACGTAACAACGTTTCTCTTCAACAGATAACGATTTTCAAC
TGTGGAGAGTTTCGTGAATTGCCACAAAGCTTGTACAATCTCCATTCTCTTAAGAGATTAGACATTTACAACTGCA
CCAACTTCAGTTCTCTTCCTGTTCCCAATGGAGACAACTATTTGACTTCCCTCGAATTCTTTTTCTTATATAATTG
TAATGGATTGATCAGTATACCAATTGGAATGCTAGATCAATGCCGGTCTCTAGAGTTTTTGCATGTCAGCTGCTGT
AACAACTTGGTTTCATTCCCTTTACATGTGTGGGAAATGCCTTCATTTTCATTTTTGGATATAAGAGAATGTCCCA
AATTGATTAGTGTACCCAAAGTGGGCCTTCACCATCTCACCGGGTTATTGAGTTTGGGAATTGGTCCTTTCTCAGA
GATGGTGGATTTTGATGCATTCCAATTGATTTTTAATGGCATTCAGCAGTTGTTGTCCCTTCGTGATCTGGAGGTG
TACGGACGTGGGCACTGGGATTCTCTGCCCTATCAGCTTATGCAACTCTCTAACCTAAGAGAGATCACAATAGCTG
```

FIG. 13C

ATTTCGGAATTGAGGCTCTTCCTCCTAGACTTGACAACCTTACTTCTCTTGAAAGTTTGACGCTAGACAGGTGCAA
ACGGCTACAACATCTGAACTTCTCAGATGCCATGCCCAAATTACGGCTTCTGTGGATAAGTGATTGTCCATTGGTA
GAAGCTCTGTCGGATGGGCTCGGCAACCTTGTTTCTTGGAAGAATTATATTTACAGGACTGCGAAAAACTAGAGC
TTCTACCGTCCCGAGATGCCATGCGACGCCTCACTAAATTATGGAACATGGGAATTAAAGGATGCCCAAAGTTAGA
AGAAAGTTTCACCAACTACTCCCAGTGGTCCAAAATTTCCCATATTTCAAATATTGAATTAGGTGGGTGGAGAAGG
ACAGCCATAAGTCTCGGTTTCTCTTTCACTTTCTGA

>324-2_J2_J5_J6
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACACTGGCTCAACAGGCGTTGAAGATGCTGAAGATGCTGAAAATGTGTTTGATCG
ATTCAGATATGAATCTCTCAAAACAAAAGTGGTGAGGAGCCCATTGAAAAAGGTCAGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATGGTACCTTCTCGGAAAATACTACCAATTCGAGAAACAGATTCCTTCGTAGGTGC
TTCTGATGTTGTTGGTAGAGATTTAGATGTTGCTGAGATAAAGGAGAAGATTTTGAAGATGAGAGAGGAGGATGTT
GTTCTGTCCACCATTCCCATAGTAGGTATGGGAGGTTTAGGGAAAACAACTGTGGCTAAGAGGATTTACAATGATG
AACACATCAAGCAAATCTTTAAAGAGAGAATTTGGTTGTGTATACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
GAATTGGGAGGAAAAAAATATTTGCTAGTCCTGGATGATTGTGGCGTGTTGACTCTACATCGTGGCATGAGTTCG
TCGACACCCTGAGAGGAATAAATACATCCAGAGGAAACTGCATTCTTGTGACTACTCGTATGAAGCGGGTGGCATC
CACAGTAGCAACAGATCTTCATATCTTGGGGAAGTTAACAGAAGATCATTGTTGGTCTATTTTCAAACAAAAGCA
TTTGTTGATGGCAGGGTTCCAGAGGAATTAGCGAGCATGGGCAACAATATTGTTAAAATGTGCCAAGGTCTACCGT
TGGCTGCAAGTGCATTGGGAGGGCTCTTACACAACAAAGAAAAACATGAATGGCAAGCAATTCTTGATGGCAACCT
CCTTGTTGCAGGTGAAGATGATAATGGAGAAAATAGCATAAAGAAAATCCTAAAACTCAGCTATGATTATCTACCA
TCTCCACATCTGAAACAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGAAGACGTTGGGCACAGGTT
TTTTCAAATCTTGTTGCAGAATTCCTTGCTACAAGATGTTGTGTTAGATGAACACAACAATATAACACACTGTAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAAAGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAATCGGGAAGCTGATATACTTGAGATATCTTGATCTCT
CGAACACTGAGATCACAGGCCTTGCCCAACTCCATTTGCGAGCTCTATAATTTGCAAACATTTAGAGTCATCAACTG
CTTTTCACTCCAGGGACTTCCATATGAGATGAGAAATATGATAAGTTTGAGACACATATATTACACTTCTATTGAC
GAAACAAGTGGGCATTGGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAGGAGGTGAATTGACAATCAATGGTCTCCAATTGGTCTGTGATAAAGAAGAGGCTCGAACAGCATATTTA
CACGATAAACCAAACATCTGCAAGCTGGCATATTTATGGTCCCATGATGAATCAGAAGGCTGTGTGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGGTTAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTATATGGTGTTGAGATTAGAAATACCGGATCAAACAGCAATATCCAAGTGTTCCCGTCATTGAAAGAACT
AGTATTGGAGGATATGCGTAGCCTTATTGAGTGGAAGGGAGATGAAGTCGGAGTAAGAATGTCTCCCGGGCTTGAG
AAGTTGCGGATTACAGACTGTCCATTGTTAAAAAGTATTCCAAATCAATTTGAAATCCTCTGTGAATTAGAAATTA
GAGGAGTTGACAGTGAAATGCCATTGTTGAACTTGTGCAGCAATCTTGACATCTCTCGTAAAGCTTAGTGTCTATGA
TATGAATGAGCTCACTTGTCTTCCAGATGAGATACTGGTAACAACGCTTTCTCCTTCAACAGATAACGATTTTCAAC
TGTGGAGAGTTTCGTGAATTGCCACAAAGCTTGTACAATCTCCATTCTCTTAAGAGATTAGACATTTACAACTGCA
CCAACTTCAGTTCTCTTCCTGTTCCCAATGGAGACAACTATTTGACTTCCCTCGAATTCTTTTTCTTATATAATTG
TAATGGATTGATCAGTATACCAATTGGAATGCTAGATCAATGCCGGTCTCTAGAGTTTTGCATGTCAGCTGCTGT
AACAACTTGGTTTCATTCCCTTTACATGTGTGGGAAATGCCTTCATTTTCATTTTTGGATATAAGAGAATGTCCCA
AATTGATTAGTGTACCCAAAGTGGGCCTTCACCATCTCACCGGGTTATTGAGTTTGGGAATTGGTCCTTTCTCAGA
GATGGTGGATTTTGATCATTCCAATTGATTTTTAATGGCATTCAGCAGTTGTTGTCCCTTCGTGATCTGGAGGTG
TACGGACGTGGGCACTGGGATTCTCTGCCCTATCAGCTTATGCAACTCTCTAACCTAAGAGAGATCACAATAGCTG
ATTTCGGAATTGAGGCTCTTCCTCCTAGACTTGACAACCTTACTTCTCTTGAAAGTTTGACGCTAGACAGGTGCAA
ACGGCTACAACATCTGAACTTCTCAGATGCCATGCCCAAATTACGGCTTCTGTGGATAAGTGATTGTCCATTGGTA
GAAGCTCTGTCGGATGGGCTCGGCAACCTTGTTTCTTGGAAGAATTATATTTACAGGACTGCGAAAAACTAGAGC
TTCTACCGTCCCGAGATGCCATGCGACGCCTCACTAAATTATGGAACATGGGAATTAAAGGATGCCCAAAGTTAGA
AGAAAGTTTCACCAACTACTCCCAGTGGTCCAAAATTTCCCATATTTCAAATATTGAATTAGGTGGGTGGAGAAGG
ACAGCCATAAGTCTCGGTTTCTCTTTCACTTTCTGA

>493-7_G2
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT

FIG. 13D

```
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACAATGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAAGGTCGGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATGGTACCTTCTCGGAAAATACTACCAATTCGAGAAACAGATTCCTTAGTAGTTGC
TTCTGATATTGTCGGTAGAGATTTGGATGTTGCTGAGATAAAGGAGAAGATTTGAAGATGAGAGAGGAGGATATT
GTTCTGTCCACCATTCCCATTGTAGGTATGGGAGGTTTAGGGAAAACAACTGTGGCTAAGAGGATTTACAATGATG
AACACATGAAGCAAATCTTTAAAAGAGAATTTGGTTGTGTCTACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
GAATTGGGAGGAAAAAATATTTGCTAGTCCTGGATGATTTGTGGCGTGTTGACTCTACATCGTGGCATGAGTTCG
TCAACACCCTGAGAGGAATAAATACATCCAGAGGAAACTGCATTCTTGTGACTACTCGTATGAAGTGGGTGGCATC
CACAGTAGCAACAGATCTTCATATCTTGGGAAGTTAACAGAAGATCATTGTTGGTCTATTTTCAAACAAAAGCA
TTTGTTGATGGCAGGGTTCCAGAGGAATTAGCGAGCATGGGCAACAAGATTGTTAAAATGTGCCAACGTCTACCGT
TGGCTGCAAGTGTGTTGGGAGGGCTCTTACACAACAAAGAAAAACATGAATGGCAAGCAATTCTTGATGGCAACCT
CCTTGTTGCAAGTGAAGATGATAATGGAGAAAATAGCATAAAGAAAATCCTAAAACTCAGCTATGATTATCTACCA
TCTCCACATCTGAAACAATGCTTTGCTTACTTTGCAATGTTTCCAAAAGATTATATGTTTGAAAAGGACCAACTAA
TCCAACTCTGGATGGCAGAAGGGTTTCTTCGTCAAGTCAAGAGATCCCTGTGATGGAAGACGTTGGGCACAGGTT
TTTTCAAATCTTGTTGCAGAATTCCTTGCTACAAGATGTTGTGTTAGATGAACACAACAATATAACACACTGTAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAAAGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCGAGCTCTATAATTTGCAAACATTTAGAGTCATCAACTG
CTTTTCACTCCAGGGACTTCCATATGAGATGAGAAATATGATAAGTTTGAGACACATATATTACACTTCTATTGAC
GAAACAAGTGGGCATTGGGGAGGATGGTGTCTTCAACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAGGAGGTGAATTGACAATCAATGGTCTCCAATTGGTCTGTGATAAAGAAGAGGCTCGAACAGCATATTTA
CACGATAAACCAAACATCTGCAAGCTGGCATATTTATGGTCCCATGATGAATCAGAAGGCTGTGTGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGGTTAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTATATGGTGTTGAGATTAGAAATACCGGATCAAACAGCAATATCCAAGTGTTCCCGTCATTGAAAGAACT
AGTATTGGAGGATATGCGTAGCCTTATTGAGGTGGAAGGGAGATGAAGTCGGAGTAAGAATGTCTCCCGGGCTTGAG
AAGTTGCGGATTACAGACTGTCCATTGTTAAAAAGTATTCCAAATCAATTTGAAATCCTCTGTGAATTAGAAATTA
GAGGAGTTGACAGTGAAATGCCATTGTTGAACTTGTGCAGCAACTTGACATCTCTCGTAAAGCTTAGTGTCTATGA
TATGAATGAGCTCACTTGTCTTCCAGATGAGATACTACGTAACAACGTTTCTCTTCAACAGATAACGATTTTCAAC
TGTGGAGAGTTTCGTGAATTGCCACAAAGCTTGTACAATCTCCATTCTCTTAAGAGATTAGACATTTACAACTGCA
CCAACTTCAGTTCTCTTCCTGTTCCCAATGGAGACAACTATTTGACTTCCCTCGAATTCTTTTTCTTATATAATTG
TAATGGATTGATCAGTATACCAATTGGAATGCTAGATCAATGCCGGTCTCTAGAGTTTTTTGCATGTCAGCTGCTGT
AACAACTTGGTTTCATTCCCTTTACATGTGTGGGAAATGCCTTCATTTTCATTTTTGGATATAAGAGAATGTCCCA
AATTGATTAGTGTACCCAAAGTGGGCCTTCACCATCTCACCGGGTTATTGAGTTTGGGAATTGGTCCTTTCTCAGA
GATGGTGGATTTTGATGCATTCCAATTGATTTTTAATGGCATTCAGCAGTTGTTGTCCCTTCGTGATCTGGAGGTG
TACGGACGTGGGCACTGGGATTCTCTGCCCTATCAGCTTATGCAACTCTCTAACCTAAGAGAGATCACAATAGCTG
ATTTCGGAATTGAGGCTCTTCCTCCTAGACTTGACAACCTTACTTCTCTTGAAAGTTTGACGCTAGACAGGTGCAA
ACGGCTACAACATCTGAACTTCTCAGATGCCATGCCCAAATTACGGCTTCTGTGGATAAGTGATTGTCCATTGTA
GAAGCTCTGTCGGATGGGCTCGGCAACCTTGTTTCTTTGGAAGAATTATATTTACAGGACTGCGAAAAACTAGAGC
TTCTACCGTCCCGAGATGCCATGCGACGCCTCACTAAATTATGGAACATGGGAATTAAAGGATGCCCAAAGTTAGA
AGAAAGTTTCACCAACTACTCCCAGTGGTCCAAAATTTCCCATATTTCAAATATTGAATTAGGTGGGTGGAGAAGG
ACAGCCATAAGTCTCGGTTTCTCTTTCACTTTCTGA

>493-7_G19
ATGAATTATTGTCTTCCTTCGAGTACTCTACAAACAACTACCAAaCGAAGACTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACAATGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAAGGTCGGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATGGTACCTTCTCGGAAAATACTACCAATTCGAGAAACAGATTCCTTAGTAGTTGC
TTCTGATATTGTCGGTAGAGATTTGGATGTTGCTGAGATAAAGGAGAAGATTTGAAGATGAGAGAGGAGGATATT
GTTCTGTCCACCATTCCCATTGTAGGTATGGGAGGTTTAGGGAAAACAACTGTGGCTAAGAGGATTTACAATGATG
AACACATGAAGCAAATCTTTAAAAGAGAATTTGGTTGTGTCTACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
```

FIG. 13E

```
GAATTGGGAGGAAAAAAATATTTGCTACTCCTGGATGATTTGTGGCGTGTTGACTCTACATCGTGGCATGAGTTCG
TCAACACCCTGAGAGGAATAAATACATCCAGAGGAAACTGCATTCTTGTGACTACTCGTATGAAGTGGGTGGCATC
CACAGTAgCAACAGATCTTCATATCTTGGGGAAGTTAACAGAAgATCATTGTTGGTCTATTTTCAAACAAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGTGTTGGGACGGCTCTTACACAACAAAGAAAAACATGAATGGCAAGCAATTCTTGATGGCAACCT
CCTTGTTGCAAGTGAAGATGATAATGGAGAAAATAGCATAAAGAAATCCTAAAACTCAGCTATGATTATCTACCA
TCTCCACATCTGAAAAAATGCTTTGCTTACtTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGATGTGTTAGATGAACACAACAATATAACACACTGCAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAACGGATCAAATAGATAAGATATATGAGCCAGAACG
TTTGTGCACACTGTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGAAGCTGATATACTTGAGATATCTTGATCtCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGATAAGCTTGAGACACATATATTACACTTCTGTTGAC
GAAACAAGTGGGCATTGGGGAGGATGGTGTCTTCACAATGAACATTTTCAGATTCCACTTAATATGGGCAATTGA
CTAGTCTTCAAACCCTCAAGTTTTTCAAGGTAGGTTTAGAGAAAGGTCGTCAAATAGAAGAATTAGGTCATTTGAA
AAACCTAAGAGGTGAATTGACGATCAATGGTCTCTGTGATAAAGAAGAGGCTCAAACAGCATATTTA
CACGATAAACCAAACATCTGCAAGCTGGCATATTTATGGTCCCATGATGAATCAGAAGGCTGTGATCAATGATG
AGCATGTGTTGGATGGTCTTCAACCGCATCCTAACTTGAAAAACCTTAGCAGTAGTGGACTATTTAGGGACTAAATT
TCCTTCATGGTTCAGTGAAAGAGTCGCTACCAAATTTGGTTAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTATATGGTGTTGAGATTAGAAATACCGGATCAAACAGCAATATCCAAGTGTTCCCGTCATTGAAAGAACT
AGTATTGGAGGATATGCGTAGCCTTATTGAGTGGAAGGGAGATGAAGTCGGAGTAAGAATGTCTACCGGGCTTGAG
AAGTTGCGGATTACAGACTGTCCATTGTTAAAAAGTATTCCAAATCAATTTGAAATCCTCTGTGAATTAGAAATTA
GAGGAGTTGACAGTGAAATGCCATTGTTGAACTTGTGCAGCAACTTGACATCTCTCGTAAAGCTTAGTGTCTATGA
TATGAATGAGCTCACTTGTCTTCCAGATGAGATACTACGTAACAACGTTTCTCTTCAACAGATAACGATTTTCAAC
TGTGGAGAGTTTCGTGAATTGCCACAAAGCTTGTACAATCTCCATTCTCTTAAGAGATTAGACATTTACAACTGCA
CCAACTTCAGTTCTCTTCCTGTTCCCAATGGAGACAACTATTTGACTTCCCTCGAATTCTTTTTCTTATATAATTG
TAATGGATTGATCAGTATACCAATTGGAATGCTAGATCAATGCCGGTCTCTAGAGTTTTTGCATGTCAGCTGCTGT
AACAACTTGGTTTCATTCCCTTTACATGTGTGGGAAATGCCTTCATTTTCATTTTTGGATATAAGAGAATGTCCCA
AATTGATTAGTGTACCCAAAGTGGGCCTTCACCATCTCACCGGGTTATTGAGTTTGGGAATTGGTCCTTTCTCAGA
GATGGTGGATTTTGATGCATTCCAATTGATTTTTAAGGCATTCAGGCATTGTTGTCCCTTCGTGATCTGGAGGTG
TACGGACGTGGGCACTGGGATTCTCTGCCCTATCAGCTTATGCAACTCTCTAACCTAAGAGAGATCACAATAGCTG
ATTTCGGAATTGAGGCTCTTCCTCCTAGACTTGACAACCTTACTTCTCTTGAAAGTTTGACGCTAGACAGGTGCAA
ACGGCTACAACATCTGAACTTCTCAGATGCCATGCCCAAATTACGGCTTCTGTGGATAAGTGATTGTCCATTGGTA
GAAGCTCTGTCGGATGGCTCGGCAACCTTGTTTCTTTGGAAGAATTATATTTACAGGACTGCGAAAAACTAGAGC
TTCTACCGTCCCGAGATGCCATGCGACGCCTCACTAAATTATGGAACATGGGAATTAAAGGATGCCCAAAGTTAGA
AGAAAGTTTCACCAACTACTCCCAGTGGTCCAAAATTTCCCATATTTCAAATATTGAATTAGGTGGGTGGAGAAGG
ACAGCCATAAGTCTCGGTTTCTCTTTCACTTTCTGA

>543-5_C2
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGACTGCAGAGGAAGAGGAAGCAAACACAACAATGGCCGATCCTGTAAT
TGGTGCTACTGTTCAAGTTTTGCTTGAAAAGTTGATTTCTCTCACTATCGAGGAAGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTGGAACAATGGCTCAACAGAGTTGAAGAGATTGTCGAAGATGCTCAAAATGTGTTTGATCG
ATTCATATATGAATCTCTCAAAACAAAAGTGGTGAGGAGCCCATTGAAAAAGGTCAGTGGTTTCTTTTCTCATACT
GCTTTTAAGAGAAAATGTCTCAAAAAATCAACAACATCAATAAAGAGTTGACGGCTATCAATAAGGTAGCCAAAG
ACCTCGGTCTACAATCACTCATGGTTCCTTCTCGGAAATACTACCAATTCGAGAAACAGATTCCTTTGTAGTTGC
TTCTGATATTGTCGGTAGAGATTTGGATATTGCTGAGATAAAGGAGAAGATTTTGAACATGAGAGAGGAGGATATT
GTTCTGTCCACCATTCCCATAGTAGGTATGGGAGGTTTAGGGAAAACAACTGTGGCTAAGAGGATTTACAATGATG
AACACATGAAGCAAATCTTTGAAAAGAGAATTTGGTTGTGTCTACCTGAAATGTCTGAAACGAAGAGCTTCTTGA
ACAAATCCTCGAATCGTTGATAGAGGAGAAATTGAGGTTGAAAGGAGATATAATAGTCAAGAAGCTACAAGAT
GAATTGGGAGGAAAAAAATATTTGCTAGTCCTGGATGATTTGTGGTGTGTTGACTCTACATCGTGGCATGAGTTCA
TTGACACCCTTGAGAGGAATAAATACATCCAGAGGAAACTGCATTCTTGTGACTACTCGTAGGAAGCAGGTGGCATC
CACAGTAGCAACAGATCTTCATATCTTGGGGAAGTTAACAGAAGATCATTGTTGGTCTATTTTCAAACAAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGTGTTGGGAGGGCTCTTACACAACAAAGAAAAACATGAATGGCAAGCAATTCTTGATGGCAACCT
CCTTGTTGCAGGTGAAGATGATAATGGAGAAAATAGCATAAAGAAATCCTAAAACTCAGCTATGATTATCTACCA
TCTCCACATCTGAAAAAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGTTCTGTTAGATGAACACAACAATATAACACACTGCAAG
ATGCACGATCTTGTGCATGATTTGGCTGGAGATATCTTAAAATCTAGACTATTTGATCCGAAGGGCGACAATGGAG
```

FIG. 13F

```
AAAAACTTTCTCAAGTTCGATACTTTGGATGTGAGTCACCAACGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGATAAGTTTGAGACACATATATTACACTTCTATTGAC
GAAACAAGTGGGCATTGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAGGAGGTGAATTGACAATCAATGGTCTCCAATTGGTCTGTGATAAAGAAGAGGCTCGAACAGCATATTTA
CACGATAAACCAAACATCTGCAAGCTGGCATATTTATGGTCCCATGATGAATCAGAAGGCTGTGAGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGGTTAAGTTGAAATTAAGTGGTAGCAAAAGGTGCAAAGAA
ATTCCATCCCTTGGCCAACTGAAATTCCTTCGGCATCTTCGTCGATAGGATTCCATGAGTTGGAATGCATTGGAC
CTGCTTTATATGGTGTTGAGATTAGAAATACCGGATCAAACAGCAATATCCAAGTGTTCCCGTCATTGAAAGAACT
AGTATTGGAGGATATGCATAGCCTTATTGAGTGGAAGGGAGATGAAGTCGGAGTAAGAATGTCTCCCGGGCTTGAG
AAGTTGCGGATTACAGACTGTCCATTGTTAAAAGTATTCCGAATCAATTTGAAATCCTCCGTGAATTAGAAATTA
GAGGAGTTGACAGTGAAATGCCATTGTTGAACTTGTGCAGCAACTTGACATCTCTCGTAAAGCTTAGTGTCTATGA
TATGAATGAGCTCACTTGTCTTCCAGATGAGATACTACGTAACAACGTTTCTCTTCAACAGATAACGATTTTCAAC
TGTGGAGAGTTTCGTGAATTGCCACAAAGCTTGTACAATCTCCATTCTCTTAAGAGATTAGACATTTACAACTGCA
CCAACTTCAGTTCTCTTCCTGTTCCCAATGGAGACAACTATTTGACTTCCCTCGAATTCTTTTACTTATATAATTG
TAATGGATTGATCAGTATACCAATTGGAATGCTAGATCAATGCCGGTCTCTAGAGTTTTTGCATGTCAGTTGCTGT
AACAACTTGGTTTCATTCCCTTTACATGTGTGGGAAATGCCTTCATTTTCATTTTGGATATAAGAGAATGTCCCA
AATTGATTAGTGTACCCAAAGTGGGCCTTCACCATCTCACCGGGTTATTGAGTTTGGCAATTGGTCCTTTCTCAGA
GATGGTGGATTTTGATGCATTCCAATTGATTTTTAATGGCATTCAGCAGTTGTTGTCCCCTTCGTGATCTGGCGGTG
TACGGACGTGGGCACTGGGATTCTCTGCCCTATCAGCTTATGCAACTCTCTAACCTAAGAGAGATCACAATAGCTG
ATTTCGGAATTGAGGCTCTTCCTCCTAGACTTGACAACCTTACTTCTCTTGAAAGTTTGACGCTAGAGAGGTGCAA
ACGGCTACAACATCTGAACTTCTCAGATGCCATGCCCAAATTACGGCTTCTGTGGATAAGTGATTGTCCATTGGTA
GAAGCTCTGTCGGATGGGCTCGGCAACCTTGTTTCTTTGGAAGAATTATATTTACAGGACTGCGAAAAACTAGAGC
TTCTACCGTCCCAGATGCCATGCGACGCCTCACTAAATTATGGAACATGGGAATTAAAGGATGCCCAAAGTTAGA
AGAAAGTTTCACCCAACTACTCCCAGTGGTCCAAAATTTCCCATATTTCAAATATTGAATTAGGTGGGTGGAGAAGG
ACAGCCATAAGTCTCGGTTTCTCTTTCACTTTCTGA

>RH_D3_D4_D7
ATGAATTATTGTCTTCCTTCGAGTACTCTACAAACAACTACCAAACGAAGACTTACTTTGAGAAGACTTTGTTGCA
TACAGCTCAGGAAGAAGACTTTGGTGCAGATTGCAGAGGAAGGAAGCAAACACAACAATGGCCGATCCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAAATGTATCATTAATCCAAGCTttCaTTCATGATGTTGAAACACCACAAG
AGAAACAACAGTCTGTCGAACAATGGCTCAACAGGCTTGAGAGAGTTGCTGAAGATGCTGAAAATGTGTTGATCG
ATTCAGATATGAATCTCTCAAAACAAAAGTGGTGAGGAGCCCATTGAAAAAGGTCGGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCCATCATGGTACCTTCTCGAAAAATACTACCAATTCGAGAAACAGATTCCTTAGTAGTTGC
TTCTGATATTTCGGTAGAGATTTGGATGTTGCTGAGATAAAGGAGAAGATTTTGAAGATGAGAGAGGAGGATATT
GTTCTGTCCACCATTCCCATTGTAGGTATGGGAGGTTTAGGGAAAACAACTGTGGCTAAGAGGATTTACAATGATG
AACACATGAAGCAAATCTTTAAAAGAGAaTTTGGTTGTGTCTACCTGAAATGTCTGAAACGAAGAGCTTTCTTGA
ACAAATCCTCGAATCATTGATAGAGAGGAAATTGAGGTTGAAAGGAGAGATATAATAGTCAAGAAGCTACAAGAT
GAATTGGGAGGAAAAAAATATTTGCTAGTCCTGGATGATTTGTGGCGTGTTGACTCTACATCGTGGCATGAGTTCG
TCGACACCCTAGGAATAAATAAATACATCCAGAGGAAACTGCATTCTTGTGACTACTCGTAGGAAGCAGGTGGCATC
CACAGTAGCAACAGATCTTCATATCTTGGGGAAGTTAACAGAAGATCATTGTTGGTCTATTTTCAAACAAAAAGCA
TTTGTTGATGCAGGGTTCCAGAGGAATTAGCGAGCATGGGCAACAAGATTGTTAAAATGTGCCAAGGTCTACCGT
TGGCTGCAAGTGCATTGGGAGGGCTCTTACACAACAAAGAAAAACATGAATGGCAAGCAATTCTTCATGGCAACCT
CCTTGTTACTGGTGAAGATGATAATGGAGAAATAGCATAAAGAAAATCCTAAAACTCAGCTATGATTATCTACCA
TCTCCACATCTGAAAAAAATGTTTTGCTTACTTTGCAAGTCGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTCAGAATTCCTTGCTACAAGATGTTGTGTTAGATGAACACAACAATATAACACACTGTAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAACGGATCAAATAGATAAGATATATGAGCCAGAACG
TTTGTGCACACTGTTTTGGAGAAGCAATTATACATCTAAAGATaTGCTGTTGAAATATAAGTTCTTGAGAGTTTTA
GATTTGTCCAGTTCAGGAATCAAGGAGTTGTCAACCAAATCGGGAAGCTGATATACTTGAGATATCTTGATCTCT
CGAACACTGAGATCACAGCCTTGCCCAACTCCATTTGCGAGCTCTATAATTTGCAAACATTTAGAGTCATCAACTG
CTTTTCACTCCAGGAACTTCCATATGAGATGAGAAATATGATAAGTTTGAGACACATATATTACACTTCTGTTGAC
GAAACAAGTGGGCATTGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAAGAGGTGAATTGACGATCAATGGTCTCCAATTGGTCTGTGATAAAGAAGAGGCTCGAACAGCATATTTA
CACGATAAACcAAACATCTGCAaGCTGGCATATTTATGGTCCCATGATGAATCAGAAGGCTGTGAGATCAATGATG
AGCATGTGTTGGATGGTCTTCAACCGCATCCTAACTTGAAAACCATAGCAGTAGTGGACTATTTAGGGACTAAATT
```

FIG. 13G

```
TCCTTCATGGTTCCGTGAAGAGTCGCTACCAAATTTGGTCAAGTTGAAATTAAGTGGAAGCAAAAGGTGCAAAGAA
ATTCCATCCCTTGGCCAACTGAAATTCCTTCGGCATCTTGAGCTGATAGGATtCCATGAGTTGGAATGCATTGGAC
CTGCTTTTTATGGTGTTGAGATTAGAAATATTGGATCAAACAGCATTATTCAAGTGTTCCCGTCATTGAAAGAACT
AGTATTGGAGGATATGCGTAGCCTTATTGAGTGGAAGGGAGATGAAGTTGGAGTAAGAATGTCTCCCGGGCTTGAG
AAGTTGCGGATTACAGACTGTCCATTGTTAAAAAGTATTCCGAATCAATTTGAAATCCTCCGTGAATTAGAAATTA
GAGGAGTTGACAGTGAAATGCCATTGTTGAACTTGTGCAGCAACTTGACATCTCTCGTGAATCTTAGTGTCTATGA
TATGAAAGAGCTCACTTGTCTTCCAGATGAGATACTACGTAACAACATTTCTCTTCAACAGATAACGATTTTCGAA
TGTGGAGAGTTTCGTGAATTGCCACAAAGCTTGTACAATCTCCATTCTCTTTATAGATTAGACATTTACAACTGCA
CCAATTTCAGTTCTCTTCCTGTTCCCAAGGGAGACAACTATTTGACTTCCCTCATATTCTTTTCTTACATAATTG
TAATGGATTGATCAGTATACCAATTGGAATGCTAGATCAATGCCGGTCTCTAGAGTATTTGCATGTCAGCTGCTGT
AACAACTTGGTTTCATTCCCTTTACATGTGTGGGAAATTCCTTCATTTTCAGTTTTGGAAATAACAGAATGTCCCA
AATTGATTAGTGtaCCCGAAGTGGGCgTTCACCATCTCACcGGGTTAtTGAGATTGGGAATTGGTCCTTTCTCAGA
GATGGTGGATTTTGATGCATTCCAATTGATTTTAATGGCATTCAGAAGTTGTTGTCTCTTCGTGATCTGGAGGTG
TACGGACGTGGGCACTGGGATTCTCTGCCCTATCAGCTTATGCAACTCTCTAACCTAAGAAAGATCACAATAGCTG
ATTTCGGAATTGAGGCTCTTCCTCCTAGACTTGACAACCTTACTTCTTCTCTTGAAAGTTTGACGGCTAGAGAGGTGCAA
ACGGCTACAACATCTGAACTTCTCAGATGCCATGCCCAAATTACGGCATCTGTGGATAAGTGATTGTCCATTGTTA
GAAGCCCTGTCGGATGGGCTCGGCAGCATTGTTTCTTTGGAAGAATTATATTTACAGGACTGCGAAAAACTAGAGC
ATCTACCGTCCCGAGATGCCATGCGACGCCTCACTAAATTATGGAACATGAGAATTAAAGGATGCCCAAAGTTAGA
AGAAAGTTTCACCAACTACTCCCAGTGGTCCAAAATTTCCCATATTTCAAATATTGAATTAGGTGGGTGGAGAAGG
ACAACCATAAGTCTCGGTTTCTCTTTCACTTTCTGA

>849-1_M8_M18_M20
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGACTGCAGAGGAAGAGGAAGCAAACACAACTATGGCCGATCCTGTAAT
TGGTGCTACTGTTCAGTTTTGCTTGAAAAGTTGATTTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACAATGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAGGTCGGTGGTTTCTTTTCTCATACT
GCTTTTAAGAGAAAAATGTCTCAAAAAATCAACAACATCAATAACAACAACAGTTGACGGCTATCAATAAGGTAGCCAAAG
ACCTCGGTCTACAATCACTCATGGTACCTTCTCGGAAAATACTACCAATTCGAGAAACAGATTCCTTAGTGGTTGC
TTCTGATATTGTCGGTAGAGATTTGGATGTTGCTGAGATAAAGGAGAAGATTTTGAACATGAGAGAGGAGGATATT
GTTCTGTCCACCATTCCCATTGTAGGTATGGGAGGTTTAGGGAAAACAACTGTGGCTAAGAGGATTTACAATGATG
AACACATGAAGCAAATCTTTAAAAAGAGAATTTGGTTGTGTCTACCTGAAATGTCTGAAACGAAGAGCTTTCTTGA
ACAAATCCTCGAATCGTTGATAGAGAGGAAAATTGAGGTTGAAAGGCAGAGATATAATAGTCAAGAAGCTACAAGAT
GAATTGGGAGGAAAAAAATATTTGCTAGTCCTGGATGATTTGTGGCGTGTTGACTCTACATCGTGGCATGAGTTCG
TCGACACCCTGAGACGGAATAAATACATCCAGAGGGAAACTGCATTCTTGTGACTACTCGTAGGAAGCAGGTGGCATC
CACAGTAGCAACAGATCTTCATATCTTGGGGAAGTTAACAGAAGATCATTGTTGGTCTATTTTCAAACAAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGCATTGGGAGGGCTCTTACACAACAAAGAAAAACATGAATGGCAAGCAATTCTTGATGGCAACCT
CCTTGTTGCTGGTGAAGATGATAATGGAGAAAATAGCATAAAGAAAATCCTAAAACTCAGCTATGATTATCtACCA
TCTCCACATCTGAAAAAATGTTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGAACACAACTATATAACACACTGTAAG
TTTTCAAATCTTGTTGCAGAATTCCTTGCTACAAGATGTTGTGTTAGATGAACACAACTATATAACACACTGTAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAACGGATCAAATAGATAAGATATATGAGCCAGAACG
TTTGTGCACACTGTTTTGGAGAAGCAATTATACATCTAAAGATATGCTGTTGAAATATAAGTTCTTGAGAGTTTTA
GATTTGTCCAGTTCAGGAATCAAGGAGTTGTCAACCAAAATCGGGAAGCTGATATACTTGAGATATCTTGATCTCT
CGAACACTGAGATCACAGCCTTGCCCAACTCCATTTGCGAGCTCTATAATTTGCAAACATTTAGAGTCATCAACTG
CTTTTCACTCCAGGACTTCCATATGAGATGAGAAATATGATAAGTTTGAGACACATATATTACACTTCTGTTGAC
AAAAGAACTCTGCATTGGGGAGGATGGTGTCTTCACAATGAACATTTTCAGATTCCACTTAATATGGGGCAATTGA
CTAGTCTTCAAAACCCTCAAGTTTTTCAAGGTAGGTTTAGAGAAAGGTCGTCAAATAGAAGAATTAGGTCATTTGAA
AAACCTAAGAGGTGAATTGACGATCAATGGTCTCCAATTGGTCTGTGATAAAGAAGAGGCTCGAACAGCATATTTA
CACGATAAACCAAACATCTGCAAGCTGGCATATTTATGGTCCCACGATGAATCAGAAGGCTGTGAGATCAATGATG
AGCATGTGTTGGATGGTCTTCAACCGCATCCTAACTTGAAACCTTAGCAGTAGTGGACTATTTAGGGACTAAATT
TCCTTCATGGTTCCGTGAAGAGTCGCTACCAAATTTGGTCAAGTTGAAATTAAGTGGAAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTTTATGGTGTTGAGATTAGAAATATTGGATCAAACAGCATTATTCAAGTGTTCCCGTCATTGAAAGAACT
AGTATTGGAGGATATGCGTAGCCTTATTGAGTGGAAGGGAGATGAAGTTGGAGTAAGAATGTCTCCCGGGCTTGAG
AAGTTGCGGATTACAGACTGTCCATTGTTAAAAAGTATTCCGAATCAATTTGAAATCCTCCGTGAATTAGAAATTA
GAGGAGTTGACAGTGAAATGCCATTGTTGAACTTGTGCAGCAACTTGACATCTCTCGTGAATCTTAGTGTCTATGA
TATGAAAGAGCTCACTTGTCTTCCAGATGAGATACTATGTAACAACATTTCTCTTCAACAGATAACGATTTTCGAA
TGTGGAGAGTTTCGTGAATTGCCACAAAGCTTGTACAATCTCCATTCTCTTTATAGATTAGACATTTACAACTGCA
CCAATTTCAGTTCTCTTCCTGTTCCCAAGGGAGACAACTATTTGACTTCCCTCATATTCTTTTCTTACATAATTG
TAATGGATTGATCAGTATACCAATTGGAATGCTAGATCAATGCCGGTCTCTAGAGTATTTGCATGTCAGCTGCTGT
```

FIG. 13H

```
AACAACTTGGTTTCATTCCCTTTACATGTGTGGGAAATTCCTTCATTTTCAGTTTTGGAAATAACAGAATGTCCCA
AATTGATTAGTGTACCCGAAGTGGGCCTTCACCATCTCACCGGGTTATTGAGATTGGGAATTGGTCCTTTCTCAGA
GATGGTGGATTTTGATGCATTCCAATTGATTTTTAATGGCATTCAGAAGTTGTGTCTCTTCGTGATCTGGAGGTG
TACGGACGTGGGCACTGGGATTCTCTGCCCTATCAGATTATGCAACTCTCTAACCTAAGAAAGATCACAATAGCTG
ATTTCGGAATTGAGGCTCTTCCTCCTAGACTTGACAACCTTACTTCTCTTGAAAGTTTGACGCTAGAGAGGTGCAA
ACGGCTACAACATCTGAACTTCTCAGATGCCATGCCCAAATTACGGCATCTGTGGATAAGTGATTGTCCATTGTTA
GAAGCCCTGTCGGATGGGCTCGGCAACATTGTTTCTTTGGAAGAATTATATTTACAGGACTGCGAAAAACTAGAGC
ATCTACCGTCCCGAGATGCCATGCGACGCCTCACTAAATTATGGAACATGAGAATTAAAGGATGCCCAAAGTTAGA
AGAAAGTTTCACCAACTACTCCCAGTGGTCCAAAATTTCCCATATTTCAAATATTGAATTAGGTGGGTGGAGAAGG
ACAACCATAAGTCTCGGTTTCTCTTTCACTTTCTGA

>852-5_E30
ATGAATTATTGTCTTCCTTCGAGTACTCTACAAACAACTCCCAAAAGAAAACTTACTTTGAGAAGACTTTGGTGCA
AACAGCTCAGGAAGAAGACTTTGGTGCAGACTGCAGAGGAAGAGGAAGCAAACACAACTATGGCCGATCCTGTAAT
TGGTGCTACTGTTCAAGTTTTGCTTGAAAAGTTGATTTCTCTCACTATCGAGGACGTCAACAGCTCAAGGGATTTC
AACAAAGATCTCGAAATGTTGACACAAATGTATCCTTAATCCAAGCTTTCATTCATGATGTTAAAACACCACAAG
TTGAGAAACAACAGTCTTTCGAACAATGGCTCAACAGGCTTGAGAGAGTTGCTGAAGATGCTCAAAATGTGTTTGA
TCGATTCAGATATGAATCTCTCAAAACAAAAGTGGTGAGGAGCCCATTGAAAAAGGTCAGTGGTTTCTTTTCTCAT
TCTGCTTTTAAGAGAAAAATGTCTCAAAATATCAACAACATAAATAAAGAGTTGACGGCTATCAATAAGGTAGCCA
AAGACCTCGGTCTACAATCACTCATGGTACCTTCTCGGAAAATACTACCAATTCGAGAAACAGATTCCTTCGTAGG
TGCTTCTGATGTTGTTGGTAGAGATTTGGATGTTGCTGAGATAAAGGAGAAGATTTTGAAGATGAGAGAGGAGGAT
GTTGTTCTGTCCACCATTCCCATAGTAGGTATGGGAGGTTTAGGGAAACAACTGTGGCTAAGAGGATTTACAATG
ATGAACACATCAAGCAAATCTTAAAGAGAGAATTTGGTTGTGTATACCTGAAATGTCTGAAACGAAGAGCTTTCT
TGAACAAATCCTCGAATCGTTGATAGAGAGGAAAATTGAGGTTGAAAGGAGAGATATAATAGTCAAGAAGCTACAA
GATGAATTGGGAGGAAAAAATATTTGCTAGTCCTGGATGATTTGTGGCGTGTTGACTCTACATCGTGGCATGAGT
TCGTCGACACCCTGAGAGGAATAAATACATCCAGAGGAAACTGCATTCTTGTGACTACTCGTAGGAAGCAGGTGGC
ATCCACAGTAGCAACAGATCTTCATATCTTGGGGAGTTAACAGAAGATCATTGTTGGTCTATTTTCAAACAAAAA
GCATTTGTTGATGGCAGGGTTCCAGAGGAATTAGCGAGCATGGGCAACAAGATTGTTAAAATGTGCCAAGGTCTAC
CGTTGGCTGCAAGTGTGTTGGGAGGGCTCTTACACAACAAAGAAAAAACATGAATGGCAAGCAATTCTTGATGGCAA
CCTCCTTGTTGCTGGTGAAGATGATAATGGAGAAAATAGCATAAAGAAAATCCTAAAACTCAGCTATGATTATCTA
CCATCTCCACATCTGAAAAAATGTTTTGCTTACTTTGCAATGTTTCCAAAAGATTATATGTTTGAAAAGGACCAAC
TAATCCAACTCTGGATGGCAGAAGGGTTTCTTCGTCCAAGTCAAGAGATCCCTGTGATGGAAGACGTTGGGCACAG
GTTTTTTCAAATCTTGTTGCAGAATTCCTTGCTACAAGATGTTGTGTTAGATGAACACAACAATATAACACACTGT
AAGATGCACGATCTTGTGCATGATTTGGCTGGAGATATCTTAAAATCTAGACTATTTGATCCGAAGGGCGACAATG
GAGAAAAACTTTCTCAAGTTCGATACTTTGGATGTGAGTCACCAACGGATCAAATAGATAAGATATATGAGCCAGA
ACGTTTGTGCACACTGTTTTGGAGAAGCAATTATACATCTAAAGATATGCTGTTGAAATATAAGTTCTTGAGAGTT
TTAGATTTGTCCAGTTCAGGAATCAAGGAGTTGTCAACCAAAATCGGGAAGCTGATATACTTGAGATATCTTGATC
TCTCGAACACTGAAATCACAGCCTTGCCCAACTCCATTTGCGAGCTCTATAATTTGCAAACATTTAGAGTCATCAA
CTGCTTTTCACTCCAGGAACTTCCATATGAGATGAGAAATATGATAAGTTTGAGACACATATATTACACTTCTGTT
GACGAAACAAGTGGGCATTGGGGAGGATGGTGTCTTCACAATGAACATTTTCAGATTCCACTTAATATGGGGCAAT
TGACTAGTCTTCAAACCCTCAAGTTTTTCAAGGTAGGTTTAGAGAAAGGTCGTCAAAATAGAAGAATTAGGTCATTT
GAAAAAACCTAAGAGGTGAATTGACGATCAATGGTCTCCAATTGGTCTGTGATAAAGAAGAGGCTTGAACAGCATAT
TTACACGATAAACCAAACATCTGCAAGCTGGCATATTTATGGTCCCACGATGAATCAGAAGGCTGTGAGATCAATG
ATGAGCATGTGTTGGATGGTCTTCAACCGCATCCTAACTTGAAAACCATAGCAGTAGTGGACTATTAGGGACTAA
ATTTCCTTCATGGTTCCGTGAAGAGTCGCTACCAAATTTGGTCAAGTTGAAATTAAGTGGAAGCAAAAGGTGCAAA
GAAATTCCATCCCTTGGCCAACTGAAATTCCTTCGGCATCTTGAGCTGATAGGATTCCATGAGTTGGAATGCATTG
GACCTGCTTTTTATGGTGTTGAGATTAGAAATATTGGATCAAACAGCATTATTCAAGTGTTCCCGTCATTGAAAGA
ACTAGTATTGGAGGATATGCGTAGCCTTATTGAGTGGAAGGGAGATGAAGTTGGAGTAAGAATGTCTCCCGGGCTT
GAGAAGTTGCGGATTACAGACTGTCCATTGTTAAAAGTATTCCGAATCAATTTGAAATCCTCCGTGAATTAGAAA
TTAGAGGAGTTGACAGTGAAATGCCATTGTTGAACTTGTGCAGCAACTTGACATCTCTCGTGAATCTTAGTGTCTA
TGATATGAAGAGCTCACTTGTCTTCCAGATGAGATACTACGTAACAACATTTCTCTTCAACAGATAACGATTTC
GAATGTGGAGAGTTTCGTGAATTGCCACAAAGCTTGTACAATCTCCATTCTCTTTATAGATTAGACATTTACAACT
GCACCAATTTCAGTTCTCTTCCTGTTCCCAAGGGAGACAACTATTTGACTTCCCTCATATTCTTTTTCTTACATAA
TTGTAATGGATTGATCAGTATACCAATTGGAATGCTAGATCAATGCCGGTCTCTAGAGTATTTGCATGTCAGCTGC
TGTAACAACTTGGTTTCATTCCCTTTACATGTGTGGGATATTCCTTCATTTTCAGTTTTGGAAATAACAGAATGTC
CCAAATTGATTAGTGTACCCGAAGTGGGCCTTCACCATCTCACCGGGTTATTGAGATTGGGAATTGGTCCTTTCTC
AGAGATGGTGGATTTTGATGCATTCCAATTGATTTTTAATGGCATTCAGAAGTTGTGTCTCTTCGTGATCTGGAG
GTGTACGGACGTGGGCACTGGGATTCTCTGCCCTATCAGCTTATGCAACTCTCTAACCTAAGAAAGATCACAATAG
CTGATTTCGGAATTGAGGCTCTTCCTCCTAGACTTGACAACCTTACTTCTCTTGAAAGTTTGACGCTAGAGAGGTG
CAAACGGCTACAACATCTGAACTTCTCAGATGCCATGCCCAAATTACGGCATCTGTGGATAAGTGATTGTCCATTG
TTAGAAGCCCTGTCGGATGGGCTCGGCAACATTGTTTCTTTGGAAGAATTATATTTACAGGACTGCGAAAAACTAG
AGCATCTACCGTCCCGAGATGCCATGCGACGCCTCACTAAATTATGGAACATGAGAATTAAAGGATGCCCAAAGTT
AGAAGAAAGTTTCACCAACTACTCCCAGTGGTCCAAAATTTCCCATATTTCAAATATTGAATTAGGTGGGTGGAGA
AGGACAACCATAAGTCTCGGTTTCTCTTTCACTTTCTGA
```

FIG. 13I

>487-1_I4_I6_I8
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAATGTATCTTTAATCCAAGCTTTCATTCATGATGTTGAAACACCACAAG
AGAAACAACAGTCTGTCGAACAATGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAAGGTCAGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATGGTACCTTCTCGGAAAATACTACCAATTCGAGAAACAGATTCCTTAGTAGTTGC
TTCTGATATTGTCGGTAGAGATTTGGATGTTGCTGAGATAAAGGAGAAGATTTTGAAGATGAGAGAGGAGGATATT
GTTCTGTCCACCATTCCCATTGTAGGTATGGGAGGTTTAGGGAAAACAACTGTGGCTAAGAGGATTTACAATGATG
AACACATGAAGCAAATCTTTAAAAAGAGAATTTGGTTCTGTCTACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
GAATTGGGAGGAAAAAAATATTTGCTAGTCCTGGATGATTTGTGGAGTGTTGACTCTACATTGTGGCATGAGTTCG
TCGACACCCTGAGAGGAATAAATACATCCAGAGGAAACTGCATTCTTGTGACTACTCGTAGGAAGCAGGTGGCATC
CACAGTAGCAACAGATCTTCATATCTTGGGGAGTTAACAGAAGATCATTGTTGGTCTATTTTCAAACAAAAAGCA
TTTGTTGATGGCAGGGTTCCAGAGGAATTAGCCGAGCATGGGCAACAAGATTGTTAAAATGTGCCAAGGTCTACCGT
TGGCTGCAAGTGCGTTGGGAGGGCTCTTACACAACAAAGAAAAACATGAATGGCAAGCAATTCTTGATGGCAACCT
CCTTGTTGCAGGTGAAGATGATAATGGAGAAAATAGCATAAAGAAAATCCTAAAACTCAGCTATGATTATCTACCA
TCTCCACATCTGAAAAAATGCTTTGCTTACTTTGCAATGTTTCCAAAAGATTATATGTTTGAAAAGGACCAACTAA
TCCAACTCTGGATGGCAGAAGGATTTCTTCGTCCAAGTCAAGAGATCCCTGTGATGGAAGACGTTGGGCACAGGTT
TTTTCAAATCTTGTTGCAGAATTCCTTGCTACAAGATGTTGTGTTAGATGAACACAACAATATAACACACTGTAAG
ATGCACGATCTTGTGCATGATTTGGCTGGACATATCTTAAAATCTAGACTATTTGATCCGAAGGGCGACGATGGAG
AAAAACTTTCTCAAGTTCGATACTTTGGATGTGAGTCACCAACGGATCAAATAGATAAGATATGTGAGCCAGAACG
TTTGTGCACACTGTTTTGGAGAAGCAATTATACATCTGAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATACCTTGATCTCT
CGAACACTGAGATCACAGCCTTGCCCAACTCCATTTGCGAGCTCTATAATTTGCAAACATTTAGAGTCATCAACTG
CTTTTCACTCCAGAAACTTCCATATGAGATGGGAAATATGGTAAGTTTGAGACACATATATTACACTTCTGTTGAC
AAAAGAAATGAGCATTGGGGAGGATGGTGTATTCTCAATGAACGTTTTCAGATGTCACTTAAGATGCGACAATTGA
CTTGTCTTCAAACCCTCAAGTTTTTCAAGATAGGTTTAAGGAAAAGGTCGTCAAATAGAAGAATTAGGTCATTTGAA
AAACCTAAGAGGTGAATTGACGATCAATGGTCTCCAATTGGTCTGTGATAAAGAAGAGGCTCGAACAGCTTATTTA
CACGATAAACCAAACATCTGCAAGCTGGCATTTTTATGGTCCCATGATGAATCAGAAGGCTCTGAGATCAATGATG
AGCATGTGTTGGATGGTCTTCAACCGCATCCTAACTTGAAAACCTTAGCAGTAGTGGACTATTTAGGGACTAAATT
TCCTTCATGGTCCATGAAGAGTCGCTACCAAATTTGGTCAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTTTATGGTGTTGAGATTAGAAATATTGGATCAAACAACATTATTCAAGTGTTCCCGTCATTGAAAGAACT
AGTATTGGAGGATATGCGTAGCCTTATTGAGTGGAAGGGAGATGAAGTTGGAGTAAGAATGTCTCCCGGGCTTGAG
AAGTTGCGGATTACAGACTGTCCATTGTTAAAAAGTATTCCGAATCAATTTGAAATCCTCCGTGAATTAGAAATTA
GAGGAGTTGACAGTGAAATGCCATTGTTGAACTTGTGCAGCAACTTGACATCTCTCGTGAATCTTAGTGTCTATGA
TATGAAAGAGCTCACTTGTCTTCCAGATGAGATACTACGTAACAACATTTCTCTTCAACAGATAACGATTTTCAAC
TGCGGAGAGTTTCGTGAATTGCCACAAAGCTTGTACAATCTCCATTCTCTTTATAGATTAGACATTTACAACTGCA
CCAATTTCAGTTCTCTTCCTGTTCCCAAGGGAGACAACTATTTGACTTCCCTCATATTCTTTTCTTACATAATTG
TAATGCATTGATCAGTATACCAATTGGAATGCTAGATCAATGCCGGTCTCTAGAGTATTTGCATGTCAGCTGCTGT
AACAACTTGGTTTCATTCCCTTTACATGTGTGGGAAATTCCTTCATTTTCAGTTTTGGAAATAACAGAATGTCCCA
AATTGATTAGTGTACCCGAAGTGGGCCTTCACCCATCTCACCGGGTTATTGAGATTGGGAATTGGTCCTTTCTCAGA
GATGGTGGATTTTGATGCATTCCAATTGATTTTTAATGGCATTCAGAAGTTGTTGTCTCTTCGTGATCTGGAGGTG
TACGGACGTGGGCACTGGGATTCTCTGCCCTATCAGCTTATGCAACTCTCTAACCCTAAGAAAGATCACAATAGCTG
ATTTCGGAATTGAGGCTCTTCCTCCTAGACTTGACAACCTTACTTCTCTTGAAAGTTTGACGCTAGAGAGGTGCAA
ACGGCTACAACATCTGAACTTCTCAGATGCCATGCCCAAATTACGGCTTCTGTGGATAAGTGATTGTCCATTGTTA
GAAGCCCTGTCGGATGGGCTCGGCAACATTGTTTCTTTGGAAGAATTATATTTACAGGACTGCGAAAAACTAGAGC
ATCTACCGTCCCGAGATGCCATGCGACGCCCTCACTAAATTATGGAACATGAGAATTAAAGGATGCCCAAAGTTAGA
AGAAAGTTTCATCAACTACTCCCAGTGGTCCAAAATTTCCCATATTTCAAATATTTGAATTAGGTGGGTGGAGAAGG
ACAGCCATAAGTCTCGGTTTCTCTTTCACTTTCTGA

>94-2031_L4_L7_L8
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAATGTATCTTTAATCCAAGCTTTCATTCATGATGTTGAAACACCACAAG
AGAAACAACAGTCTGTGGAACAATGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAAGGTCAGTGGTTTCTTTTCTCATACT
GCTTTTAAGAGAAAAATGTCTCAAAAAATCAACAACATAAATAAAGAGTTGACGGCTATCAATAAGGTAGCCAAAG
ACCTCGGTCTACAATCACTCATGGTACCTTCTTGGAAAATACTACCAATTCGAGAAACAGATTCCTTCGTAGGTGC

FIG. 13J

```
TTCTGATGTTGTTGGTAGAGATTTGGATGTTGCTGAGATAAAGGAGAAGATTTTGAACATGAGAGAGGAGGATGTT
GTTCTGTCCACCATTCCCATAGTAGGTATGGGAGGTCTAGGGAAAACAACTGTGGCTAAGAGGATTTACAATGATG
AACACATCAAGCAAATCTTTAAAGAGAGAATTTGGTTGTGTATACCTGAAATGTCTGAAACGAAGAGCTTTCTTCA
ACAAATCCTCGAATCGTTGATAGAGAGGAAAATTGAGGTTGAAAGGAGAGATATAATAGTCAAGAAGCTACAAGAT
GAATTGGGAGGAAAAAAATATTTGCTAGTCCTGGATGATTTGTGGCGTGTTGACTCTACATCGTGGCATGAGTTCG
TCGACACCCTGAGAGGAATAAATACATCCAGAGGAAACTGCATTCTTGTGACTACTCGTAGGAAGCAGGTGGCATC
CACAGTAGCAACAGATCTTCATATCTTGGGGAAGTTAACAGAAGATCATTGTTGGTCTATTTTCAAACAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGTGTTGGGAGGGCTCTTACACAACAAAGAAAAACATGAATGGCAAGCAATTCTTGATGGCAACCT
CCTTGTTGCAGGTGAAGATGATAATGGAGAAAATAGCATAAAGAAAATCCTAAAACTCAGCTATGATTATCTACCA
TCTCCACATCTGAAAAAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGTTCTGTTAGATGAACACAACAATATAACACACTGCAAG
ATGCACGATCTTGTGCATGATTTGGCTGGAGATATCTTAAAATCTAGACTATTTGATCCGAAGGGCAACAATGGAG
AAAAACTTTCTCAAGTTCGATACTTTGGATGTGAGTCACCAACGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGATAAGTTTGAGACACATATATTACACTTCTGTTGAC
GAAACAAGTGGGCATTGGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCCTAAGAGGTGAATTGACGATCAATGGTCTCCAATTGGTCTGTGATAAAGAAGAGGCTCAAACAGCATATTA
CACGATAAACCAAACATCTGCAAGCTGCCATATTTATGGTCCCATGATGAATCGAGAGGCTGTGAGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGGTCGAGTTGAAATTAAGTGGTAGCAAAAGGTGCAAACAA
ATTCCATCCCTTGGCCAACTGAAATTCCTTCGGCATCTTGAGCTGGTAGGATTCCATGAGTTGGAATGCATTGGAC
CTGCTTTTTATGGTGTTGAGATGAGAAATATTGGATCAAACAGCATTATCCAAGTGTTCCCGTCATTGAAAAAACT
AGTATTGAAGGATATGCGTAGCCTTATTGAGTGGAAGGGAGATGAAGTTGGAGTAAGAATGTCTCCCGGTCTTGAG
AAGTTGCGGATTACAGACTGTCCATTGTTAAAAAGTATTCCGAATCAATTTGAAATCCTCCGTCAATTAAAAATTA
CAGGAGTTGACAGTGAAATGCCATTGTTGAACTTGTCCAGCAACTTGACATCTCTCGTAAAGCTTAGAGTCTATGA
TATGAAAGAGCTCACTTGTCTTCCAGATGAGATGCTACGTAACAACGTTTCTCTTCAACAGATAATAATTTTCAAC
TGCCGGAGAGTTTCGTGAATTGCCACAAAGCTTGTACAATCTCCATTCTCTTAGGAGATTAGACATTTACAACTGCA
CCAATTTCAGTTCTCTTCCTGTTCCCAATGGAGGCAACTATTTGACTTCCCTCGAATTCTTTTGCTTATATAATTG
TAATGGATTGATCAGTATACCAATTGGAATGCTAGATCAATGCCGGCTAGTGTTTTGAATGTCAGCTGCTGTAAC
AACTTGGTTTCATTCCCTGTACATGTGTGGGAAATGCCTTCACTTTCATATTTGGTTATATCAGAATGTCCCCAAT
TGATTAGTGTACCCAAAGTGGGCCTTCACCATCTCACCATCGTTAGTGAGATTGGGAATTGGTCCTTTCTCAGAGAT
GGTGGATTTTGATGCATTCCAATTGATTTTTAATGGCATTCAGCAGTTGTTGTCCCCTTCGTGATCTGGAGGTGTAC
GGACGTGGGCACTGGGATTCTCTGCCCTATCAGCTTATGCAACTCTCTGACCTAAGAGAGATCACAATAGCTGATT
TCGGAATTGAGGCTCTTCCTCCTACTCTTGACAACCTTACTTCTCTTGAAAGTTTGACGCTAGTGAGGTGCAAACA
GCTACAACATCTGAACTTCTCAGATGCCATGCCCAAATTACGGCTCCTGTGGATACGTGATTGTCCATTGTTAGAA
GCTCTGTCGGATGGGCTCGGCAACCTTGTTTCTTTGGAAGAATTATATTTACATGACTGCGAAAACTAGAGCATC
TACCGTCCCGAGATGCCATGCGACGCCCTCACTAAATTATGGAACATGAGAATTAAAGGATGCCCAAAGTTAGAAGA
AAGTTTCACCAACTACTCCCAGTGGTCCAAAATTTCCCATATTTCAAATATTGAATTAGGTGGGTGGAGAAGGACA
GCCATAAGTCTCGGTTTCTCTTTCACTTTCTGA

>s661-2_K4_K14_K22
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCCGAAATGTTGACACAAAATGTATCTTTAATCCAAGCTTTCATTCATGATGTTGAAACACCACAAG
AGAAACAACAGTCTGTGGAACAATGGCTCAACAGGCTTGAGAGAGTTGCTGAAGATGCTGAAAATGTGTTTGATCG
ATTCAGATATGAATCTCTCAAAACAAAGTGGTGAGGAGCCCATTGAAAAAGGTCAGTGGTTTCTTTTCTCATACT
GCTTTTAAGAGAAAAATGTCTCAAAAAATCAACAACATAAATAAAGAGTTGACGGCTATCAATAAGGTAGCCAAAG
ACCTCGGTCTACAATCACTCATGGTACCTTCTTGGAAGATATTACTACCAATTCGAGAAACAGATTCCTTCGTAGGTGC
TTCTGATGTTGTTGGTAGAGATTTGGATGTTGCTGAGATAAAGGAGAAGATTTTGAACATGAGAGAGGAGGATGTT
GTTCTGTCCACCATTCCCATAGTAGGTATGGGAGGTTTAGGGAAAACAACTGTGGCTAAGAGGATTTACAATGATG
AACACATCAAGCAAATCTTTAAAGAGAGAATTTGGTTGTGTATACCTGAAATGTCTGAAACGAAGAGCTTTCTTCA
ACAAATCCTCGAATCGTTGATAGAGAGGAAAATTGAGGTTGAAAGGAGAGATATAATAGTCAAGAAGCTACAAGAT
GAATTGGGAGGAAAAAAATATTTGCTAGTCCTGGATGATTTGTGGCGTGTTGACTCTACATCGTGGCATGAGTTCG
TCGACACCCTGAGAGGAATAAATACATCCAGAGGAAACTGCATTCTTGTGACTACTCGTAGGAAGCAGGTGGCATC
CACAGTAGCAACAGATCTTCATATCTTGGGAAGTTAACAGAAGATCATTGTTGGTCTATTTTCAAACAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGTGTTGGGAGGGCTCTTACACAACAAAGAAAAACATGAATGGCAAGCAATTCTTGATGGCAACCT
CCTTGTTGCAGGTGAAGATGATAATGGAGAAAATAGCATAAAGAAAATCCTAAAACTCAGCTATGATTATCTACCA
```

FIG. 13K

```
TCTCCACATCTGAAAAAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGTTCTGTTAGATGAACACAACAATATAACACACTGCAAG
ATGCACGATCTTGTGCATGATTTGGCTGGAGATATCTTAAAATCTAGACTATTTGATCCGAAGGGCAACAATGGAG
AAAAACTTTCTCAAGTTCGATACTTTGGATGTGAGTCACCAACGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGATAAGTTTGAGACACATATATTACACTTCTGTTGAC
GAAACAAGTGGGCATTGGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAAGAGGTGAATTGACGATCAATGGTCTCCAATTGGTCTGTGATAAAGAAGAGGCTCAAACAGCATATTTA
CACGATAAACCAAACATCTGCAAGCTGGCATATTTATGGTCCCATGATGAATCAGAAGGCTGTGAGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGGTCGAGTTGAAATTAAGTGGTAGCAAAAGGTGCAAAGAA
ATTCCATCCCTTGGCCAACTGAAATTCCTTCGGCATCTTGAGCTGGTAGGATTCCATGAGTTGGAATGCATTGGAC
CTGCTTTTTATGGTGTTGAGATGAGAAATATTGGATCAAACAGCATTATCCAAGTGTTCCCGTCATTGAAAAAACT
AGTATTGAAGGATATGCGTAGCCTTATTGAGTGGAAGGGAGATGAAGTTGGAGTAAGAATGTCTCCCGGTCTTGAG
AAGTTGCGGATTACAGACTGTCCATTGTTAAAAGTATTCCGAATCAATTTGAAATCCTCCGTCAATTAAAAATTA
CAGGAGTTGACAGTGAAATGCCATTGTTGAACTTGTCAGCAACTTGACATCTCTCGTAAAGCTTAGAGTCTATGA
TATGAAAGAGCTCACTTGTCTTCCAGATGAGATGCTACGTAACAACGTTTCTCTTCAACAGATAATAATTTTCAAC
TGCGGAGAGTTTCGTGAATTGCCACAAAGCTTGTACAATCTCCATTCTCTTAGGAGATTAGACATTTACAACTGCA
CCAATTTCAGTTCTCTTCCTGTTCCCAATGGAGGCAACTATTTGACTTCCCTCGAATTCTTTTGCTTATATAATTG
TAATGGATTGATCAGTATACCAATTGGAATGCTAGATCAATGCCGGCTAGTGTTTTtGAATGTCAGCTGCTGTAAC
AACTTGGTTTCATTCCCTGTACATGTGTGGGAAATGCCTTCACTTTCATATTTGGTTATATCAGAATGTCCCAAAT
TGATTAGTGTACCCAAAGTGGGCCTTCACCATCTCACCGGGTTAGTGAGATTTGGGGAATTGGTCCTTTCTCAGAGAT
GGTGGATTTTGATGCATTCCAATTGATTTTTAATGCATTCAGCAGTTGTTGTCCCTTCGTGATCTGGAGGTGTAC
GGACGTGGGCACTGGGATTCTCTGCCCTATCAGCTTATGCAACTCTCTGACCTAAGAGAGATCACAATAGCTGATT
TCGGAATTGAGGCTCTTCCTCCTACTCTTGACAACCTTACTTCTCTTGAAAGTTTGACGCTAGTGAGGTGCAAACA
GCTACAACATCTGAACTTCTCAGATGCCATGCCCAAATTACGGCTCCTGTGGATACGTGATTGTCCATTGTTAGAA
GCTCTGTCGGATGGGCTCGGCAACCTTGTTTCTTTGGAAGAATTATATTTACATGACTGCGAAAACTAGAGCATC
TACCGTCCCGAGATGCCATGCGACGCCTCACTAAATTATGGAACATGAGAATTAAAGGATGCCCAAAGTTAGAAGA
AAGTTTCACCAACTACTCCCAGTGGTCCAAAATTTCCCATATTTCAAATATTGAATTAGGTGGGTGGAGAAGGACA
GCCATAAGTCTCGGTTTCTCTTTCACTTTCTGA

>324-2_J1_J3_J8
atgaattactgtcttCCTTCGaGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAATGTATCTTAATCCAAGCTTTCATTCATGATGTTGAAACACCACAAG
AGAAACAACAGTCTGTGGAACAATGGCTCAACAGGCTTGAGAGAGTTGCTGAAGATGCTGAAAATGTGTTTGATCG
ATTCAGATATGAATCTCTCAAAACAAAGTGGTGAGGAGCCCATTGAAAAAGGTCAGTGGTTTCTTTTCTCATACT
GCTTTTAAGAGAAAATGTCTCAAAAAATCAACAACATAAATAAAGAGTTGACGGCTATCAATAAGGTAGCCAAAG
ACCTCGGTCTACAATCACTCATGGTACCTTCTTGGAAAATACTACCAATTCGAGAAACAGATTCCTTCGTAGGTGC
TTCTGATGTTGTTGGTAGAGATTTGGATGTTGCTGACATAAAGGAGAAGAATTTTGAACATGAGAGAGGAGGATGTT
GTTCTGTCCACCATTCCCATAGTAGGTATGGGAGGTTTAGGGAAAACAACTGCTAAGAGGGATTTACAATGATG
AACACATCAAGCAAATCTTTAAAGAGAGAATTTGGTTGTGTATACCTGAAATGTCTGAAACGAAGAGCTTTCTTCA
ACAAATCCTCGAATCGTTGATAGAGACGGAAAATTGAGGTTGAAAGGAGAGATAATAGTCAAGAAGCTACAAGAT
GAATTGGAGGAAAAAAATATTTGCTAGTCCTGGATGATTTGTGGCGTGTTGACTCTACATCGTGGCATGAGTTCG
TCGACACCCTGAGAGGAATAAATACATCCAGAGGAAACTGCATTCTTGTGACTACTCGTAGGAAGCAGGTGGCATC
CACAGTAGCAACAGATCTTCATATCTTGGGGAAGTTAACGAAGATCATTGTTGGTCTATTTTCAAACAAAAAGCA
TTTGTTGATGGCAGGGTTCCAGGAGGAATTAGCGAGCATGGGCAACAGATTGTTAAAATGTGCCAAGGTCTACCGT
TGGCTGCAAGTGTGTTGGGAGGGCTCTTACACAACAAAGAAAAACATGAGCAAGCAATTCTTGATGGCAACCT
CCTTGTTGCAGGTGAAGATGATAATGGAGAAAATAGCATAAAGAAAATCCTAAAACTCAGCTATGATTATCTACCA
TCTCCACATCTGAAAAAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGTTCTGTTAGATGAACACAACAATATAACACACTGCAAG
ATGCACGATCTTGTGCATGATTTGGCTGGAGATATCTTAAAATCTAGACTATTTGATCCGAAGGGCAACAATGGAG
AAAAACTTTCTCAAGTTCGATACTTTGGATGTGAGTCACCAACGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGATAAGTTTGAGACACATATATTACACTTCTGTTGAC
GAAACAAGTGGGCATTGGGGAGGATGGTGTCTTCACAATGAACATTTTCAGATTCCACTTAATATGGGGCAATTGA
```

FIG. 13L

CTAGTCTTCAAACCCTCAAGTTTTTCAAGGTAGGTTTAGAGAAAGGTCGTCAAATAGAAGAATTAGGTCATTTGAA
AAACCTARGAGGTGAATTGACRATCAATGGTCTCCAATTGGTCTGTGATAAAGAAGAGGGCTCRAACAGCATATTTA
CACGATAAACCAAACATCTGCAAGCTGGCATATTTATGGTCCCATGATGAATCAGAAGGCTGTGAGATCAATGATG
AGCaTGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGCTCGAGTTGAAATTAAGTGGTAGCAAAAGGTGCAAAGAA
ATTCCATCCCTTGGCCAACTGAAATTCCTTCGGCATCTTGAGCTGGTAGGATTCCATGAGTTGGAATGCATTGGAC
CTGCTTTTTATGGTGTTGAGATGAGAAATATTGGATCAAACAGCATTATCCAAGTGTTCCCGTCATTGAAAAAACT
AGTATTGAAGGATATGCGTAGCCTTATTGAGTGGAAGGGAGATGAAGTTGGAGTAAGAATGTCTCCCGGTCTTGAG
AAGTTGCGGATTACAGACTGTCCATTGTTAAAAAGTATTCCGAATCAATTTGAAATCCTCCGTCAATTAAAAATTA
CAGGAGTTGACAGTGAAATGCCATTGTTGAACTTGTGCAGCAACTTGACATCTCTCGTAAAGCTTAGAGTCTATGA
TATGAAAGAGCTCACTTGTCTTCCAGATGAGATGCTAACGACAACGTTTCTCTTCAACAGATAATAATTTCAAC
TGCGGAGAGTTTCGTGAATTGCCACAAAGCTTGTACAATCTCCATTCTCTTAGGAGATTAGACATTTACAACTGCA
CCAATTTCAGTTCTCTTCCTGTTCCCAATGGAGGCAACTATTTGACTTCCCTCGAATTCTTTGCTTATATAATTG
TAATGGATTGATCAGTATACCAATTGGAATGCTAGATCAATGCCGGCTAGTGTTTTGAATGTCAGCTGCTGTAAC
AACTTGGTTTCATTCCCTGTACATGTGTGGGAAATGCCTTCACTTTCATATTTGGTTATATCAGAATGTCCCAAAT
TGATTAGTGTACCCAAAGTGGGCCTTCACCATCTCACCGGGTTAGTGAGATTGGGAATTGGTCCTTTCTCAGAGAT
GGTGGATTTTGATGCATTCCAATTGATTTTTAATGGCATTCAGCAGTTGTTGTCCCTTCGTGATCTGGAGGTGTAC
GGACGTGGGCACTGGGATTCTCTGCCCTATCAGCTTATGCAACTCTCTGACCTAAGAGAGATCACAATAGCTGATT
TCGGAATTGAGGCTCTTCCTCCTACTCTTGACAACCTTACTTCTCTTGAAAGTTTGACGCTAGTGAGGTGCAAACA
GCTACAACATCTGAACTTCTGACATGCCATGCCCAAATTACGGCTCCTGTGGATACGTGATTGTCCATTGTTAGAA
GCTCTGTCGGATGGGCTCGGCAAACCTTGTTTCTTTGGAAGAATTATATTTACATGACTGCGAAAAACTAGAGCATC
TACCGTCCCGAGATGCCATGCGACGCCTCACTAAATTATGGAACATGAGAATTAAAGGATGCCCAAAGTTAGAAGA
AAGTTTCACCAACTACTCCCAGTGGTCCAAAAATTTCCCATATTTCAAATATTGAATTAGGTGGGTGGAGAAGGACA
GCCATAAGTCTCGGTTTCTCTTTCACTTTCTGA

>852-5_E14_E23
ATGAATTATTGTCTTCCTTCGAGTACTCTACAAACAACTCCCAAAAGAAAACTTACTTTGAGAAGACTTTGGTGCA
AACAGCTCAGGAAGAAGACTTTGGTGCAGACTGCAGAGGAAGAGGAAGCAAACACAACTATGGCCGATCCTGTAAT
TGGTGCTACTGTTCAAGTTTTGCTTGAAAAGTTGATTTCTCACTATCGAGGACGTCAACAGCTCAAGGGATTTC
AACAAAGATCTCGAAATGTTGACACAAAATGTATCTTAATCCAAGCTTTCATTCATGATGTTAAAACACCACAAG
TTGAGAAACAACAGTCTTTCGAACAATGGCTCAACAGGCTTGAGAGAGTTGCTGAAGATGCTCAAAATGTGTTTGA
TCGATTCAGATATGAATCTCTCAAAACAAAAGTGGTGAGGAGCCCATTGAAAAAGGTCAGTGGTTTCTTTTCTCAT
TCTGCTTTTAAGAGAAAAATGTCTCAAAATATCAACAACATAAATAAAGAGTTGACGGCTATCAATAAGGTAGCCA
AAGACCTCGGTCTACAATCACTCATGGTACCTTCTCGGAAATACTACCAATTCGAGAAACAGATTCCTTCGTAGG
TGCTTCTGATGTTGTTGGTAGAGATTTGGATGTTGCTGAGATAAAGGAGAAGATTTTGAAGATGAGAGAGGAGGAT
GTTGTTCTGTCCACCATTCCCATAGTAGGTATGGGAGGTTTAGGGAAAACAACTGTGGCTAAGAGGATTTACAATG
ATGAACACATCAAGCAAATCTTTAAAGAGAGAATTTGGTTGTGTATACCTGAAATGTCTGAAACGAAGAGCTTTCT
TGAACAAATCCTGAATCGTTGATAGAGAGGAAATTGAGGTTGAAGGAGAGATAATAGTCAAGAAGCTACAA
GATGAATTGGGAGGAAAAAATATTTGCTAGTCCTGGATGATTTGTGGCGTGTTGACTCTACATCGTGGCATGAGT
TCGTCGACACCCTGAGAGGAATAAATACATCCAGAGGAAACTGCATTCTTGTGACTACTCGTAGGAAGCAGGTGGC
ATCCACAGTAGCAACAGATCTTCATATCTTGGGGAAGTTAACAGAAGATCATTGTTGGTCTATTTTCAAACAAAAA
GCATTTGTTGATGGCAGGGTTCCAGAGGAATTAGCGAGCATGGGCAACAAGATTGTTAAAATGTGCCAAGGTCTAC
CGTTGGCTGCAAGTGTGTTGGAGGGCTCTTACACAACAAAGAAAAACATGAATGGCAAGCAATTCTTGATGGCAA
CCTCCTTGTTGCAGGTGAAGATGATAATGGAGAAAATAGCATAAAGAAAATCCTAAAACTCAGCTATGATTATCTA
CCATCTCCACATCTGAAAAAATGCTTTGCTTACTTTGCAATGTTTCCAAAAGATTATATGTTTGAAAAGGACCAAC
TAATCCAACTCTGGATGGCAGAAGGGTTCTTCGTCCAAGTCAAGAGATCCCTGTGATGGAAGACGTTGGGCACAG
GTTTTTTCAAATGTTGCAGAATTCCTTGCTACAAGATGTTCTGTTAGATGAACACAACAATATAACACACTGC
AAGATGCACGATCTTGTGCATGATTTGGCTGGAGATATCTTAAAATCTAGACTATTTGATCCGAAGGGCGACAATG
GAGAAAAACTTTCTCAAGTTCGATACTTTGGATGTGAGTCACCAACGGATCAAATAGATAAGATATATGAGCCAGA
ACGTTTGTGCACACTGTTTTGGAGAAGCAATTATACATCTAAAGATATGCTGTTGAACTTTAAGTTCTTGAGAGTT
TTAGATTTGTCCAGTTCAGGAATCAAGGAGTTGTCAGCCAAAATCGGGAAGCTGATATACTTGAGATATCTTGATC
TCTCGAACACTGAGATCACAGCCTTGCCCAACTCCATTTGCAAGCTCTATAATTTGCAAACATTTAGAGTCATCAA
CTGCTTTTCACTCCAGGAACTTCCATATGAGATGAGAAATATGATAAGTTTGAGACACATATATTACACTTCTGTT
GACGAAACAAGTGGGCATTGGGAGGATGGTGTCTTCACAATGAACATTTTCAGATTCCACTTAATATGGGCAAT
TGACTAGTCTTCAAACCCTCAAGTTTTTCAAGGTAGGTTTAGAGAAAGGTCGTCAAATAGAAGAATTAGGTCACTT
GAAAAACCTAAGAGGTGAATTGACGATCAATGGTCTCCAATTGGTCTGTGATAAAGAAGAGGCTCAAACAGCATAT
TTACACGATAAACCAAACATCTGCCAAGCTGGCATATTTATGGTCCCATGATGAATCAGAAGGCTGTGAGATCAATG
ATGAGCATGTGTTGGATGGTCTTCAACCGCATCCTAACTTGAAAACCTTAGCAGTAGTGGACTATTTAGGGACTAA
ATTTCCTTCATGGTTCAGTGAAGAGTCGCTACCAAATTTGGTCAAGTTGAAATTAAGTGGTAGCAAAAGGTGCAAA
GAAATTCCATCCCTTGGCCAACTGAAATTCCTTCGGCATCTTGAGCTGATAGGATTCCATGAGTTGGAATGCATTG
GACCTGCTTTTTATGGTGTTGAGATGAGAAATATTGGATCAAACAGCATTATCCAAGTGTTCCCGTCATTGAAAAA
ACTAGTATTGAAGGATATGCGTAGCCTTATTGAGTGGAAGGGAGATGAAGTTGGACTAACAATGTCTCCCGGTCTT
GAGAAGTTGCGGATTACAGACTGTCCATTGTTAAAAAGTATTCCGAATCAATTTGAAATCCTCCGTCAATTAAAAA
TTACAGGAGTTGACAGTGAAATGCCATTGTTGAACTTGTGCAGCAACTTGACATCTCTCGTAAAGCTTAGAGTCTA

FIG. 13M

```
TGATATGAAAGAGCTCACTTGTCTTCCAGATGAGATGCTACGTAACAACGTTTCTCTTCAACAGATAATAATTTTC
AACTGCGGAGAGTTTCGTGAATTGCCACAAAGCTTGTACAATCTCCATTCTCTTAGGAGATTAGACATTTACAACT
GCACCAATTTCAGTTCTCTTCCTGTTCCCAATGGAGACAACTATTTGACTTCCCTCGAATTCTTTGCTTACATAA
TTGTAATGGATTGATCAGTATACCAGTTGGAATGCTAGATCAATGCCGGCTAGTGTTTTGAATGTCAGCTGCTGT
AACAACTTGGTTTCATTCCCTGTACATGTGTGGGAAATGCCTTCACTTTCATATTTGGTTATATCAGAATGTCCCA
AATTGATTAGTGTACCCAAAGTGGGCCTTCACCATCTCACCGGGTTAGTGAGATTGGGAATTGGTCCTTTCTCAGA
GATGGTGGATTTTGATGCATTCCAATTGATTTTTAATGGCATTCAGCAGTTGTTGTCCCTTCGTGATCTGGAGGTG
TACGGACGTGGGCACTGGGATTCTCTGCCCTATCAGCTTATGCAACTCTCTGACCTAAGAGAGATCACAATAGCTG
ATTTCGGAATTGAGGCTCTTCCTCCTACTCTTGACAACCTTACTTCTCTTGAAAGTTTGACGCTAGTGAGGTGCAA
ACAGCTACAACATCTGAACTTCTCAGATGCCATGCCCAAATTACGGCTCCTGTGGATACGTGATTGTCCATTGTTA
GAAGCTCTGTCGGATGGGCTCGGCAACCTTGTTTCTTGGAAGAATTATATTTACATGACTGCGAAAAACTAGAGC
ATCTACCGTCCCGAGATGCCATGCGACGCCTCACTAAATTATGGAACATGAGAATTAAAGGATGCCCAAAGTTAGA
AGAAAGTTTCACCAACTACTCCCAGTGGTCCAAAATTTCCCATATTTCAAATATTGAATTAGGTGGGTGGAGAAGG
ACAGCCATAAGTCTCGGTTTCTCTTTCACTTTCTGA

>852-5_E28
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGACTGCAGAGGAAGAGGAAGCAAACACAACTATGCCGATGCTGTAAT
TGGTGCTACTGTTCAAGTTTTGCTTGAAAAGTTGATTTCTCTCACTATCGAGGACGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACAATGGCTCAACAGGCTTGAGAGAGTTGCTGAAGATGCTGAAAATGTGTTTGATCG
ATTCAGATATGAATCTCTCAAAACAAAGTGGTGAGGAGCCCATTGAAAAAGGTCAGTGGTTTCTTTTCTCATACT
GCTTTTAAGAGAAAAATGTCTCAAAAAATCAACACATCAATAAAGAGTTGACGGCTATCAATAAGGTAGCCAAAG
ACCTCGGTCTACAATCACTCATGGTACCTTCTCGGAAAATACTACCAATTCGAGAAACAGATTCCTTCGTAGGTGC
TTCTGATGTTGTTGGTAGAGATTTGGATGTTGCTGAGATAAAGGAGAAGATTTTGAAGATGAGAGAGGAGGATGTT
GTTCTGTCCACCATTCCCATAGTAGGTATGGGAGGTTTAGGGAAACAACTGTGGCTAAGAGGATTTACAATGATG
AACACATGAAGCAAATCTTTAAAAAGAGAATTTGGTTGTGTCTACCTGAAATGTCTGAAACGAAGAGCTTTCTTGA
CAAAATCCTCGAATCATTGATAGAGAGGAAAATTGAGGTTGAAAGGAGAGATATAATAGTCAAGAAGCTACAAGAT
GAATTGGGAGGAAAAAATATTTGCTAGTCCTGGATGATTTGTGGCGTGTTGACTCTACATCGTGGCATGAGTTCG
TCGACACCCTGAGAGGAATAAATACATCCAGAGGAAACTGCATTCTTGTGACTACTCGTAGGAAGCAGGTGGCATC
CACAGTAGCAACAGATCTTCATATCTTGGGAAGTTAACAGAAGATCATTGTTGGTCTATTTTCAAACAAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGTGTTGGGAGGGCTCTTACACAACAAAGAAAAACATGAATGGCAAGCAATTCTTGATGGCAACCT
CCTTGTTGCAGGTGAAGATGATAATGGAGAAAATAGCATAAAGAAAATCCTAAAACTCAGCTATGATTATCTACCA
TCTCCACATCTGAAAAAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGTTCTGTTAGATGAACACAACAATATAACACACTGCAAG
ATGCACGATCTTGTCATGATTTGGCTGGAGATATCTTAAAATCTAGACTATTTGATCCGAAGGGCGACAATGGAG
AAAAACTTTCTCAAGTTCGATACTTTGGATGTGAGTCACCAACGGATCAAATAGATAAGATAATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGATAAGTTTGAGACACATATATTACACTTCTGTTGAC
GAAACAAGTGGGCATTGGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCACTTGAA
AAACCTAAGAGGTGAATTGACGATCAATGGTCTCCAATTGGTCTGTGATAAAGAAGAGGCTCAAACAGCATATTTA
CACGATAAACCAAACATCTGCAAGCTGGCATATTTATGGTCCCATGATGAATCAGAAGGCTGTGAGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTGGTCAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTTTATGGTGTTGAGATGAGAAATATTGGATCAAACAGCATTATCCAAGTGTTCCCGTCATTGAAAAAACT
AGTATTGAAGGATATGCGTAGCCTTATTGAGTGGAAGGGAGATGAAGTTGGAGTAAGAATGTCTCCCGGTCTTGAG
AAGTTGCCGGATTACGACTGTCGTCCATTGTTAAAAAGTATTCCGAAATCAATTTGAAATCCTCCGTCAATTAAAAATTA
CAGGAGTTGACAGTGAAATGCCATTGTTGAACTTGTCAGCAACTTGACATCTCTCGTAAAGCTTAGAGTCTATGA
TATGAAAGAGCTCACTTGTCTTCCAGATGAGATGCTACGTAACAACGTTTCTCTTCAACAGATAATAATTTTCAAC
TGCGGAGAGTTTCGTGAATTGCCACAAAGCTTGTACAATCTCCATTCTCTTAGGAGATTAGACATTTACAACTGCA
CCAATTTCAGTTCTCTTCCTGTTCCCAATGGAGACAACTATTTGACTTCCCTCGAATTCTTTTGCTTACATAATTG
TAATGGATTGATCAGTATACCAGTTGGAATGCTAGATCAATGCCGGCTAGTGTTTTGAATGTCAGCTGCTGTAAC
AACTTGGTTTCATTCCCTGTACATGTGTGGGAAATGCCTTCACTTTCATATTTGGTTATATCAGAATGTCCCAAAT
TGATTAGTGTACCCAAAGTGGGCCTTCACCATCTCACCGGGTTAGTGAGATTGGGAATTGGTCCTTTCTCAGAGAT
GGTGGATTTTGATGCATTCCAATTGATTTTTAATGGCATTCAGCAGTTGTTGTCCCTTCGTGATCTGGAGGTGTAC
GGACGTGGGCACTGGGATTCTCTGCCCTATCAGCTTATGCAACTCTCTGACCTAAGAGAGATCACAATAGCTGATT
TCGGAATTGAGGCTCTTCCTCCTACTCTTGACAACCTTACTTCTCTTGAAAGTTTGACGCTAGTGAGGTGCAAACA
GCTACAACATCTGAACTTCTCAGATGCCATGCCCAAATTACGGCTCCTGTGGATACGTGATTGTCCATTGTTAGAA
```

FIG. 13N

```
GCTCTGTCGGATGGGCTCGGCAACCTTGTTTCTTTGGAAGAATTATATTTACATGACTGCGAAAACTAGAGCATC
TACCGTCCCGAGATGCCATGCGACGCCTCACTAAATTATGGAACATGAGAATTAAAGGATGCCCAAAGTTAGAAGA
AAGTTTCACCAACTACTCCCAGTGGTCCAAAATTTCCCATATTTCAAATATTGAATTAGGTGGGTGGAGAAGGACA
GCCATAAGTCTCGGTTTCTCTTTCACTTTCTGA

>543-5_C10_C15_C24=Rpi-chc1
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGACTGCAGAGGAAGAGGAAGCAAACACAACAATGGCCGATCCTGTAAT
TGGTGCTACTGTTCAAGTTTTGCTTGAAAAGTTGATTTCTCTCACTATCGAGGAAGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTGGAACAATGGCTCAACAGGCTTGAGAGAGTTGCTGAAGATGCTCAAAATGTGTTTGATCG
ATTCATATATGAATCTCTCAAAACAAAAGTGGTGAGGAGCCCATTGAAAAGGTCAGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATGGTTCCTTCTCGGAAAATACTACCAATTCGAGAAACAGATTCCTTTGTAGTTGC
TTCTGATATTGTCGGTAGAGATTTGGATATTGCTGAGATAAAGGAGAAGATTTTGAACATGAGAGAGGAGGATATT
GTTCTGTCCACCATTCCCATAGTAGGTATGGGAGGTTTAGGGAAAACAACTGTGGCTAAGAGGATTTACAATGATG
AACACATGAAGCAAATCTTTGAAAAGAGAATTTGGTTGTGTCTACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
GAATTGGGAGGAAAAAATATTTGCTAGTCCTGGATGATTTGTGGTGTGTTGACTCTACATCGTGGCATGAGTTCA
TTGACACCTTGAGAGGAATAAATACATCCAGAGGAAACTGCATTCTTGTGACTACTCGTAGGAAGCAGGTGGCATC
CACAGTAGCAACAGATCTTCATATCTTGGGAAGTTAACAGAAGATCATTGTTGGTCTATTTTCAAACAAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGTGTTGGGAGGGCTCTTACACAACAAAGAAAAACATGAATGGCAAGCAATTCTTGATGGCAACCT
CCTTGTTGCAGGTGAAGATGATAATGGAGAAAATAGCATAAAGAAAATCCTAAAACTCAGCTATGATTATCTACCA
TCTCCACATCTCGAAAAAATGCTTTGCTTACTTTGAAACATGTTTCCAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGTTCTGTTAGATGAACACAACAATATAACACACTGCAAG
ATGCACGATCTTGTGCATGATTTGGCTGAGATATCTTAAAATCTAGACTATTTGATCCGAAGGGCGACAATGGAG
AAAAACTTTCTCAAGTTCGATACTTTGGATGTGAGTCACCAACGGATCAAATAGATAAGATATATGAGCCAgAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCCTTGCCCAACTCCATTGCCACATCTCTATAATTTGCAAACATTTAGAGTCATCAACTG
CTTTTCACTCCAGGAACTTCCATATGAGATGAGAAATATGATAAGTTTGAGACACATATATTACACTTCTGTTGAC
GAAACAAGTGGGCATTGGGGAGGATGGTGTCTTCACAATGAACATTTTCAGATTCCACTTAATATGGGCAATTGA
CTAGTCTTCAAACCCTCAAGTTTTTCAAGGTAGGTTTAGAGAAAGGTCGTCAAATAGAAGAATTAGGTCATTTGAA
AAACCTAAGAGGTGAATTGACGATCAATGGTCTCCAATTGGTCTGTGATAAAGAAGAGGCTCAAACAGCATATTTA
CACGATAAACCAAACATCTGCAAGCTGGCATATTTATGGTCCCATGATGAATCAGAAGGCTGTGAGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGGTCAAGTTGAAATTAAGTTGGTAGCAAAAGGTGCAAAGAA
ATTCCATCCCTTGCCCACTCGAAATTCCTTCGGCATCTTGAGCTGATAGGATTCCATGAGTTGGAATGCATTGGAC
CTGCTTTTTATGGTGTTGAGATGAGAAATATTGGATCAAACAGCATTATCCAAGTGTTCCCGTCATTGAAAAAACT
AGTATTGAAGGATATGCGTAGCCTTATTGAGTGGAAGGGAGATGAAGTTGGAGTAAGAATGTCTCCCGGTCTTGAG
AAGTTGCGGATTACAGACTGTCCATTGTTAAAAGTATTCCGAATCAATTTGAAATCCTCCGTCAATTAAAAATTA
CAGGAGTTGACAGTGAAATGCCATTGTTGAACTTGTGCAGCAACTTGACATCTCTCGTAAAGCTTAGAGTCTATGA
TATGAAAGAGCTCACTTGTCTTCCAGATGAGATGCTACGTAACAACGTTTCTCTTCAACAGATAATAATTTTCAAC
TGCCGGAGAGTTTCGTGAATTGCCACAAAGCTTGTACAATCTCCATTCTCTTAGGAGATTAGACATTTACAACTGCA
CCAATTTCAGTTCTCTTCCCTGTTCCCAATGGAACATCTCTTGAGCTTACTTCCCTCGAATTCTTTTGCTTACATAATTG
TAATGGATTGATCAGTATACCAATTGGAATGCTAGATCAATGCCGGCTAGTGTTTTGAATGTCAGCTGCTGTAAC
AACTTGGTTTCATTCCCTGTACATGTGTGGGAAATGCCTTCACTTTCATATTTGCTTATATCAGAATGTCCCAAAT
TGATTAGTGTACCCAAAGTGGGCCTTCACCATCTCACCGGGTTAGTGAGATTGGGAATTGGTCCTTTCTCAGAGAT
GGTGGATTTTGATGCATTCCAATTGATTTTAATGGCATTCAGCAGTTGTTGTCCCTTCGTGATCTGGAGGTGTAC
GGACGTGGGCACTGGGATTCTCTGCCCTATCAGCTTATGCAACTCTCTGACCTAAGAGAGATCACAATAGCTGATT
TCGGAATTGAGGCTCTTCCTCCTACTCTTGACAACCTTACTTCTCTTGAAAGTTTGACGCTAGTGAGGTGCAAACA
GCTACAACATCTGAACTTCTCAGATGCCATGGGAGGCTCCTGTGGACAGTGATTGTCCATTGTTAGAA
GCTCTGTCGGATGGGCTCGGCAACCTTGTTTCTTTGGAAGAATTATATTTACATGACTGCGAAAAACTAGAGCATC
TACCGTCCCGAGATGCCATGCGACGCCTCACTAAATTATGGAACATGAGAATTAAAGGATGCCCAAAGTTAGAAGA
AAGTTTCACCAACTACTCCCAGTGGTCCAAAATTTCCCATATTTCAAATATTGAATTAGGTGGGTGGAGAAGGACA
GCCATAAGTCTCGGTTTCTCTTTCACTTTCTGA >493-9_H5_H30
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
```

FIG. 13O

```
AGAAACAACAGTCTGTCGAACAATGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAAGGTCAGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATCGTACCTTCTCGGAAAATACTACCAATTCGAGAAACAGATTCCATCGTAGGTGC
TTCTGATGTTGTTGGTAGAGATTTGGATGTTGCTGAGATAAAGGAGAAGATTTTGAAGATGAGAGAGGAGGATGTT
GTTTTGTCCACCATTCCCATAGTAGGTATGGGAGGTTTAGGGAAAACAACTGTGGCTAAGAGGATTTACAATGATG
AACACATCAAGCAAATCTTTAAAGAGAGAATTTGGTTGTGTATACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
GAATTGGGAGGAAAAAAATATTTGCTAGTCCTGGATGATTTGTGGCGTGTTGACTCTACATCGTGGCATGAGTTCG
TCAACACCCTGAGAGGAATAAATACATCCAGAGGAAACTGCATTCTTGTGACTACTCGTATGAAGTGGGTGGCATC
CACAGTAGCAACAGATCTTCATATCTTGGGGAAGTTAACAGAAGATCATTGTTGGTCTATTTTCAAACAAAAAGCA
TTTGTTGATGGCAGGGTTCCAGAGGAATTAGCGAGCATGGGCAACAAGATTGTTAAATGTGCCAAGGTCTACCGT
TGGCTGCAAGTGCGTTGGGAGGGCTCTTACACAACAAAGAAAAACATGAATGGCAAGCAATTCTTGATGGCAACCT
CCTTGTTGCAAGTGAAGATGATAATGGAGAAAATAGCTTAAAGAAAATCCTAAAACTCAGCTATGATTATCTACCA
TCTCCACATCTGAAAAAATGCTTTGCTTACTTTGCAATGTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTGCTTGCTACAAGATGATGTGTTAGATGAACACAACAATATAACACACTGCAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAACGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGATAAGTTTGAGACACATATATTACACTTCTGTTGAC
GAAACAAGTGGGCATTGGGGAGGATGGTGTCTTCACAATGAACATTTTCAGATTCCACTTAATATGGGCAATTGA
CTAGTCTTCAAACCCTCAAGTTTTTCAAGGTAGGTTTAGAGAAAGGTCGTCAAATAGAAGAATTAGGTCATTTGAA
AAACCTAAGAGGTGAATTGACGATCAATGGTCTCCAATTGGTCTGTGATAAAGAAGAGGCTCAAACAGCATATTTA
CACGATAAACCAAACATCTGCAAGCTGGCATATTTATGGTCCCATGATGAATCAGAAGGCTGTGAGATCAATGATG
AGCATGTGTTGGATGGTCTTCAACCGCATCCTAACTTGAAAAACCTTAGCAGTAGTGGACTATTTAGGGACTAAATT
TCCTTCATGGTTCAGTGAAGAGTCGCTACCAAATTTGGTCAAGTTGAAATTAAGTGGTAGCAAAAGGTGCAAAGAA
ATTCCATCCCTTGGCCAACTGAAATTCCTTCGGCATCTTGAGCTGATAGGATTCCATGAGTTGGAATGCATTGGAC
CTGCTTTTTATGGTGTTGAGATGAGAAATATTGGATCAAACAGCATTATCCAAGTGTTCCCGTCATTGAAAAAACT
AGTATTGAAGGATATGCGTAGCCTTATTGAGTGGAAGGGAGATGAAGTTGGAGTAAGAATGTCTCCCGGGCTTGAG
AAGTTGCGGATTATAGACTGTCCATTGTTAAAAAGTATCCCGAATCAATTTGAAATCCTCCGTCAATTAGACATTA
GAGGAGTTGACAGTGAAATGCCATTGTTGAACTTGCAGCAATCTCTCGTAAAGCTTAGTGTCTATGA
TATGAAAGAGCTCACTTGCTTCCAGATGAGATGCTACGTAACAACGTTTCTCTTCAACAGATAATAATTTTCAAC
TGCGGAGAGTTTCGTGAATTGCCACAAAGCTTGTACAATCTCCATTCTCTTAGGAGATTAGACATTTTCAACTGCA
CCAATTTCAGTTCTCTTCCTGTTCCCAATGGAGACAACTATTTGACTTCCCTCGAATTCTTTTACTTATATAATTG
TAATGGATTGATCAGTATACCAATTGGAATGCTAGATCAATGCCGGCTAGTGTTTTGAATGTCAGCTGCTGTAAC
AACTTGGTTTCATTCCCTTTACATGTGTGGGAAATGCCTTCATTTTCAGTTTTGAATATAAAAGAATGTCCCAAAT
TGATTAGTGTACCCAAAGTGGGGCCTTCACCATCTCACCGGGTTAGTGAGATTGGGAATTGGTCCTTTCTCAGAGAT
GGTGGATTTTGATGCATTCCAATTGATTTTTAATGGCATTCAGCAGTTGTCCCTTCGTGATCTGGAGGTGTACGGA
CGTGGGCACTGGGATTCTCTGCCCTATCAGCTTATGCAACTCTCTTGAAAGTTTGACGCTAGTGAGGTGCAAACAGCT
GAATTGAGGCTCTTCCTCCTACTCTTGACAACCTTACTTCTCGTGAAAGTTTGACGCTAGTGAGGTGCAAACAGCT
ACAACATCTGAACTTCTCAGATGCCATGCCCAAATTACGGCTCCTGTGGATACGTGATTGTCCATTGTTAGAAGCT
CTGTCGGATGGGCTCGGCAACCTTGTTTCTTTGGAAGAATTATATTTACATGACTGCGAAAAACTAGAGCATCTAC
CGTCCCGAGATGCCATGCGACGCCTCACTAAATTATGGAACATGGGAATTAAAGGCTGCCCAAAGTTAGAAGAAAG
TTTCATCAACTACTCCCAGTGGTCCAAAATTTCCCATATTTCAGTTATTGAATTAGGTGGGTGGAGAAGGACAACC
GTAAGTCTCGGTTTCTCTTTCACTTTCTGA

>493-7_G14_G22
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAAGAGGAAGCAAACACAACTATGGCCGATGCTGTAAT
TGGTGCTACTGTTCAAGTTTTTGCTTGAAAAGTTGATTTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACAATGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAAGGTCGGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATCGGTACCTTCTCGGAAAATACTACCAATTCGAGAAACAGATTCCTTAGTAGTTGC
TTCTGATATTGTCGGTAGAGATTTGGATGTTGCTGAGATAAAGGAGAAGATTTTGAAGATGAGAGAGGAGGATATT
GTTCTGTCCACCATTCCCATTGTAGGTATGGGAGGTTTAGGGAAAACAACTGTGGCTAAGAGGATTTACAATGATG
AACACATGAAGCAAATCTTTAAAAAGAGAATTTGGTTGTGTCTACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
GAATTGGGAGGAAAAAAATATTTGCTAGTCCTGGATGATTTGTGGCGTGTTGACTCTACATCGTGGCATGAGTTCG
TCAACACCCTGAGAGGAATAAATACATCCAGAGGAAACTGCATTCTTGTGACTACTCGTATGAAGTGGGTGGCATC
```

FIG. 13P

```
CACAGTAGCAACAGATCTTCATATCTTGGGGAAGTTAACAGAAGATCATTGTTGGTCTATTTTCAAACAAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGTGTTGGGAGGGCTCTTACACAACAAAGAAAAACATGAATGGCAAGCAATTCTTGATGGCAACCT
CCTTGTTGCAAGTGAAGATGATAATGGAGAAAATAGCATAAAGAAAATCCTAAAACTCAGCTATGATTATCTACCA
TCTCCACATCTGAAAAAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGATCAAGAGATCCCTGTGATGGAAGACGTTGGGCACAGGTT
TTTTCAAATCTTGTTGCAGAATTCCTTGCTACAAGATGATGTGTTAGATGAACACAACAATATAACACACTGCAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAACGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGAGACACTTGAGACACATATATTACACTTCTGTTGAC
GAAACAAGTGGGCATTGGGGAGGATGGTGTCTTCACAATGAACATTTTCAGATTTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAAGAGGTGAATTGACGATCAATGGTCTCCAATTGGTCTGTGATAAAGAAGAGGCTCAAACAGCATATTTA
CACGATAAACCAAACATCTGCAAGCTGGCATATTTATGGTCCCATGATGAATCAGAAGGCTGTGAGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCTCTACCAAATTTGGTCAAGTTGAAATTAAGTGGTAGCAAAAGGTGCAAAGAA
ATTCCATCCCTTGGCCAACTGAAATTCCTTCGGCATCTTGAGCTGATAGGATTCCACGAGTTGGAATGCATTGGAC
CTGCTTTTTATGGTGTTGACATTAGAAATATTGGATCAAACAGCATTATCCAAGTGTTCCCGTCATTGAAAAAACT
AGTATTGACGGATATGCGTAGCCCTTATTGAGTGGAAGGGAGATGAAGTTGGAGTAAGAATGTCTCCCGGGCTTGAG
AAGTTGCGGATTACAGACTGTCCATTGTTAAAAAGTATCCCGAATCAATTTGAAATCCTCCGTCAATTAGACATTA
GAGGAGTTGACAGTGAAATACCATTGTGGAACTTGTGCAGCAACTTGACATCTCTCGTAAAGCTTAGTGTCTATGA
TATGAAAGAGCTCACTTGTCTTCCAGATGAGATGCTACGTAACAACGTTTCTCTTCAACAGATAATGATTTTCGAC
TGTGGAGAGTTTCGTGAATTGCCACAAAGCTTGTACAATCTCCATTTTCTTAAGAGATTAGAAATTTACAACTGCA
CCAATTTCAGTTCTCTTCCTGTTCCCAATGGAGACAACTATTTGACTTCCCTCCAATTCTTTCAGTTATATAATTG
TGATGGATTGATCAGTTTACCAATTGGAATGCTAGATCAATGCCGGTCTCTAGAGTGTTTGTCTGTCAGCTGCTGT
AACAACTTGGTTTCATTCCCTTTACATGTGTGGGAAATGCCTTCACTTTCATATTTGGTTATATCAGAATGTCCCA
AATTGATTAGTGTACCCGAAGTGGGCCTTCACCGTCTCACTGGGTTATTGAGATTGGGAATTGGTCCTTTCTCAGA
GATGGTGGATTTTGATGCATTCCAATTGATTTTTAATGCATTCAGCAGCTGTTGTCCCTTAGTGATCTGAAGGTG
TATGGACATGGGCACTGGGATTCTCTGCCCTATCAGCTTATGCAACTCTCTGACCTAAGAGAGATCCAAATAGCTG
ATTTCGGAATTGAGGCTCTTCCACCTAGACTTGACAACCTTACTTCTCTTGAAAGTTTGACGCTAGTGAGGTGCAA
ACGGCTACAACATCTGAACTTCTCAGATGCCATGCCCTCATTACGGCTTCTGTGGATACGTGATTGTCCATTGTTA
GAAGCTCTGTCGGATGATCTCGGCAACCTTGTTTCTTTGGAAGAATTATATTTACTTGACTGCAAAAAACTAGAGG
GTCTACCGTCCCGAGATGCCATGCGACGCCTCACTAAATTATGGAACTTGGGAATTAAAGGCTGCCCAAAGTTAAA
AGAAACCGGTGGTCCAAGATTTCCCATATTCCAAGAATTGAATTTGGTGGGATGATAATTAAGGACACATGTAAGTGT
TGGTTTCTCTTTCACTTTCTGAAC

>561-2_K6_K30_K31
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGATTGCAGAGGAGGAGAAGCAAACACAACTATGGCCGATGCTGTAAT
TGGTGCTACTGTTCAAGTTTTGCTTGAAAAGTTGATTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACAATGGCTCAACAGGCTTGAGAGAGTTGCTGAAGATGCTGAAAATGTGTTTGATCG
ATTCAGATATGAATCTCTCAAAACAAAAGTGGTGAGGAGCCCATTGAAAAAGGTCGGTGGTTTCTTTTCTCATACT
GCTTTTAAGAGAAAAATGTCTCAAAAAATCAACAACATCAATAAAGAGTTGACGGCTATCAATAAGGTAGCCAAAG
ACCTCGGTCTACAATCACTCATGGTACCTTCTCGGAAAATACTACCAATTCGAGAAACAGATTCCTTAGTAGTTGC
TTCTGATATTGTCGGTAGAGATTTGGATGTTGCTGAGATAAAGGAGAAGATTTTGAAGATGAGAGGAGGAGATATT
GTTCTGTCCACCATTCCCATTGTAGGTATGGGAGGTTTAGGGAAAACAACTGTGGCTAAGAGGGATTTACAATGATG
AACACATGAAGCAAATCTTTAAAAGAGAATTTGGTTGTGTCTACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
GAATTAGGAGGAAAAAATATTTGCTAGTCCTGGATGATTTGTGGCGTGTTGACTCTACATCGTGGCATGAGTTCG
TCAACACCCTGAGAGGAATAAATACATCCAGAGGAAACTGCATTCTTGTGACTACTCGTATGAAGTGGGTGGCATC
CACAGTAGCAACAGATCTTCATATCTTGGGGAAGTTAACAGAAGATCATTGTTGGTCTATTTTCAAACAAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGTGTTGGGAGGGCTCTTACACAACAAAGAAAAACATGAATGGCAAGCAATTCTTGATGGCAACCT
CCTTGTTGCAAGTGAAGATGATAATGGAGAAAATAGCATAAAGAAAATCCTAAAACTCAGCTATGATTATCTACCA
TCTCCACATCTGAAAAAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGATCCCTGTGATGGAAGACGTTGGGCACAGGTT
TTTTCAAATCTTGTTGCAGAATTCCTTGCTACAAGATGATGTGTTACATGAACACAACAATATAACACACTGCAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAGCGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
```

FIG. 13Q

```
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGATAAGCTTGAGACACATATATTACACTTCTGTTGAC
GAAACAAGTGGGCATTGGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAAGAGGTGAATTGACGATCAATGGTCTCCAATTGGTCTGTGATAAAGAAGAGGCTCAAACAGCATATTTA
CACGATAAACCAAACATCTGCAAGCTGGCATATTTATGGTCCCATGATGAATCAGAAGGCTGTGAGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCTCTACCAAATTTGGTCAAGTTGAAATTAAGTGGTAGCAAAAGGTGCAAAGAA
ATTCCATCCCTTGGCCAACTGAAATTCCTTCGGCATCTTGAGCTGATAGGATTCCACGAGTTGGAATGCATTGGAC
CTGCTTTTTATGGTGTTGAGATTAGAAATATTGGATCAAACAGCATTATCCAAGTGTTCCCGTCATTGAAAAAACT
AGTATTGACGGATATGCGTAGCCTTATTGAGTGGAAGGGAGATGAAGTTGGAGTAAGAATGTCTCCCGGGCTTGAG
AAGTTGCGGATTACAGACTGTCCATTGTTAAAAAGTATCCCGAATCAATTTGAAATCCTCCGTCAATTAGACATTA
GAGGAGTTGACAGTGAAATACCATTGTTGAACTTGTGCAGCAACTTGACATCTCTCGTAAAGCTTAGTGTCTATGA
TATGAAAGAGCTCACTTGTCTTCCAGATGAGATCTACGTAACAACGTTTCTCTTCAACAGATAATGATTTTCGAC
TGCGGAGAGTTTCGTGAATTGCCACAAAGCTTGTACAATCTCCATTTTCTTAAGAGATTAGAAATTTACAACTGCA
CCAATTTCAGTTCTCTTCCTGTTCCCAATGGAGACAACTATTTGACTTCCCTCCAATTCTTTCAGTTATATAATTG
TGATGGATTGATCAGTTTACCAATTGGAATGCTAGATCAATGCCGGTCTCTAGAGTGTTTGTCTGTCAGCTGCTGT
AACAACTTGGTTTCATTCCCTTTACATGTGTGGGAAATGCCTTCACTTTCATATTTGGTTATATCAGAATGTCCCA
AATTGATTAGTGTACCCGAAGTGGGCCTTCACCGTCTCACTGGGTTATTGAGATTGGGAATTGGTCCTTTCTCAGA
GATGGTGGATTTTGATGCATTCCAATTGATTTTTAATGGCATTCAGCAGCTGTTGTCCCTTAGTGATCTGGAGGTG
TATGGACATGGGCACTGGGATTCTCTGCCCTATCAGCTTATGCAACTCTCTGACCTAAGAGAGATCCAAATAGCTG
ATTTCGGAATTGAGGCTCTTCCACCCTAGACTTGACAACCTTACTTCTCTTGAAAGTTTGACGCTAGTGAGGTGCAA
ACGGCTACAACATCTGAACTTCTCAGATGCCATGCCCTCATTACGGCTTCTGTGGATACGTGATTGTCCATTGTTA
GAAGCTCTGTCGGATGATCTCGGCAACCTTGTTTCTTTGGAAGAATTATATTTACTTGACTGCAAAAAACTAGAGG
GTCTACCGTCCCGAGATGCCATGCGACGCCTCACTAAATTATGGAACTTGGGAATTAAAGGCTGCCCAAAGTTAAA
AGAAACGTGGTCCAAGATTTCCCATATTCCAAGAATTGAATTTGGTGGGATGATAATTAAGGACACATRTAAGTGT
TGGTTTCTCTTTCACTTTCTGAAC

>493-7_G21
ATGAATTATTGTCTTCCTTCGAGTACTCTACAAACAACTACCAAACGAAgACTTACTTTGAGAAGACTTTGTTGCA
AACAGCTCAGGAACAAGACTTTGGTGCAGATTGCAGAGGAAGAGGAAGCAAACACAACTATGGCCGATGCTGTAAT
TGGTGCTACTGTTCAAGTTTTGCTTGAAAAGTTGATTTCTCTCACTATCGAGGAGGTCAACAGCTCAAGGGATTTC
AACAAAGATCTCGAAATGTTGACACAAAATGTATCTTTAATCCAAGCTTTCATTCATGATGTTGAAACACCACAAG
AGAAACAACAGTCTGTCGAACACTGGCTCAACAGGCTTGAGGAGTTGCTGAAGATGCTGAAAATGTGTTTGATCG
ATTCAGATATGAATCTCTCAAAACAAAAGTGGTGAGGAGCCCATTGAAAAAGGTCAGTGGTTTCTTTTCTCATACT
GCTTTTAAGAAAAATGTCTCAAAAAATCAACAACATCAATAAAGAGTTGACGGCTATCAATAAGGGTAGCCAAAG
ACCTCGGTCTACAATCACTCATGGTACCTTCTCGGAAATACTACCAATTCGAGAAACAGATTCCTTCGTAGGTGC
TTCTGATGTTGTTGGTAGAGATTTAGATGTTGCTGAGATAAAGGAGAAGATTTTGAAGATGAGAGAGGAGGATGTT
GTTCTGTCCACCATTCCCATAGTAGGTATGGGAGGTTTAGGGAAAACAACTGTGGCTAAGAGGATTTACAATGATG
AACACATCAAGCAAATCTTTAAAGAGAGAATTTGGTTGTGTATACCTGAAATGTCTGAAACGAAGAGCTTTCTTGA
ACAAATCCTGAACTCGTTGATAGAGGAGGAAAATTGAGGTTGAGAAGGAGAGATAATAATAGTCAAGAAGCTACAAGAT
GAATTGGGAGGAAAAAAATATTTGCTAGTCCTGGATGATTTGTGGCGTGTTGACTCTACATCGTGGCATGAGTTCG
TCGACACCCTGAGAGGAATAAATACATCCAGAGGGAAACTGCATTCTTGTGACTACTCGTATGAAGCGGGTGGCATC
CACAGTAGCAACAGATCTTCATATCCTTGGGAAGTTAACAGAAgATCATTGTTGGTCTATTTTCAAACaAAAAGCA
TTTGTTGATGGCAGGGTTCCAgAGGAATTAgCGAgCATGGGCAACACTATTGTTAAAATGTGCCAAGGTCTACCGT
TGGCTGCAAGTGCATTGGGAGGGCTCTTACACAACAAAGAAAAACATGAATGGCAAGCAATTCTTGATGGCAACCT
CCTTGTTGCAGGTGAAGATGATAATGGAgAAAATAGCATAAAgAAAATCCTAAAACTCAGCTATGATTATCTACCA
TCTCCACATCTGAAACAATGCTTTGCTTACTTTGCAATGTTTCCAAAAGATTATATGTTTGAAAAGGACCAACTAA
TCCAACTCTGGATGGCAGAAGGGTTTCTTCGTCCAAGTCAAGAGATCCCTGTGATGGAAGACGTTGGGCACAGGTT
TTTTCAAATCTTGTTGCAGAATTCCTTGCTACAAGATGTTGTGTTAGATGAACACAACAATATAACACACTGTAAG
ATGCACGATCTTGTGCATGATTTGGCTGGAGATATCTTAAAATCTAGACTATTTGATCCGAAGGGCGACAATGGAG
AAAAACTTTCTCAAGTTCGATACTTTGGATGTGAGTCACCAAAGGATCAAATAGATAAGATATATGAGCCAGAACG
TTTGTGCACACTGTTTTGGAGAAGCAATTATACATCTAAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAATTTGCAAACATTTAGAGTCATCAACTG
CTTTTCACTCCAGGAACTTCCATATGAGATGAGAAATATGATAAGCTTGAGACACATATATTACACTTCTGTTGAC
GAAACAAGTGGGCATTGGGGAGGATGGTGTCTTCACAATGAACATTTTCAGATTCCACTTAATATGGGGCAATTGA
CTAGTCTTCAAACCCTCAAGTTTTTCAAGGTAGGTTTAGAGAAAGGTCGTCAAATAGAAGAATTAGGTCATTTGAA
AAACCTAAGAGGTGAATTGACGATCAATGGTCTCCAATTGGTCTGTGATAAAGAAGAGGCTCAAACAGCATATTTA
CACGATAAACCAAACATCTGCAAGCTGGCATATTTATGGTCCCATGATGAATCAGAAGGCTGTGAGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCTCTACCAAATTTGGTCAAGTTGAAATTAAGTGGTAGCAAAAGGTGCAAAGAA
ATTCCATCCCTTGGCCAACTGAAATTCCTTCGGCATCTTGAGCTGATAGGATTCCACGAGTTGGAATGCATTGGAC
```

FIG. 13R

```
CTGCTTTTTATGGTGTTGAGATTAGAAATATTGGATCAAACAGCATTATCCAAGTGTTCCCGTCATTGAAAAAACT
AGTATTGACGGATATGCGTAGCCTTATTGAGTGGAAGGGAGATGAAGTTGGAGTAAGAATGTCTCCCGGGCTTGAG
AAGTTGCGGATTACAGACTGTCCATTGTTAAAAAGTATCCCGAATCAATTTGAAATCCTCCGTCAATTAGACATTA
GAGGAGTTGACAGTGAAATACCATTGTTGAACTTGTGCAGCAACTTGACATCTCTCGTAAAGCTTAGTGTCTATGA
TATGAAAGAGCTCACTTGTCTTCCAGATGAGATGCTACGTAACAACGTTTCTCTTCAACAGATAATGATTTTCGAC
TGTGGAGAGTTTCGTGAATTGCCACAAAGCTTGTACAATCTCCATTTTCTTAAGAGATTAGAAATTTACAACTGCA
CCAATTTCAGTTCTCTTCCTGTTCCCAATGGAGACAACTATTTGACTTCCCTCCAATTCTTTCAGTTATATAATTG
TGATGGATTGATCAGTTTACCAATTGGAATGCTAGATCAATGCCGGTCTCTAGAGTGTTTGTCTGTCAGCTGCTGT
AACAACTTGGTTTCATTCCCTTTACATGTGTGGGAAATGCCTTCACTTTCATATTTGGTTATATCAGAATGTCCCA
AATTGATTAGTGTACCCGAAGTGGGGCCTTCACCGTCTCACTGGGTTATTGAGATTGGGAATTGGTCCTTTCTCAGA
GATGGTGGATTTTGATGCATTCCAATTGATTTTTAATGGCATTCAGCAGCTGTTGTCCCTTAGTGATCTGGAGGTG
TATGGACATGGGCACTGGGATTCTCTGCCCTATCAGCTTATGCAACTCTCTGACCTAAGAGAGATCCAAATAGCTG
ATTTCGGAATTGAGGCTCTTCCACCTAGACTTGACAACCTTACTTCTCTTGAAAGTTTGACGCTAGTGAGGTGCAA
ACGGCTACAACATCTGAACTTCTCAGATGCCATGCCCTCATTACGGCTTCTGTGGATACGTGATTGTCCATTGTTA
GAAGCTCTGTCGGATGATCTCGGCAACCTTGTTTCTTTGGAAGAATTATATTTACTTGACTGCAAAAAACTAGAGG
GTCTACCGTCCCGAGATGCCATGCGACGCCTCACTAAATTATGGAACTTGGGAATTAAAGGCTGCCCAAAGTTAAA
AGAAACGTGGTCCAAGATTTCCCATATTCCAAGAATTGAATTTGGTGGGATGATAATTAAGGACACATGTAAGTGT
TGGTTTCTCTTTCACTTTCTGAAC

>493-7_G10
ATGAATTATTGTCTTCCTTCGAGTACTCTACAAACAACTACCAAACGAAGACTTACTTTGAGAAGACTTTGTTGCA
AACAGCTCAGGAAGAAGACTTTGGTGCAGACTGCAGAGGAAGAGGAAGCAAACACAACTATGGCCGATCCTGTAAT
TGGTGCTACTGTTCAAGTTTTGCTTGAAAAGTTGATTTCTCTCACTATCGAGGAGGTCAACAGCTCAAGCGGATTTC
AACAAAGATCTCGAAATGTTGACACAAAATGTATCTTTAATCCAAGCTTTCATTCATGATGTTGAAACACCACAAG
AGAAACAACAGTCTGCTCGACAATGGCTCAACAGGCTTGAGAGATTGCTGAACAGATGCTGAAAATGTGTTTGATCG
ATTCAGATATGAATCTCTCAAAACAAAAGTGGTAGGAGCCCATTGAAAAAGGTCGGTGGTTTCTTTTCTCATATT
GCTTTTAAGAGAAAAATGTCTCAAAAATCAACAACATCAATAAAGAGTTGACGGCTATCAATAAGGTAGCCAAAG
ACCTCGGTCTACAATCACTCATGGTACCTTCTCGGAAAATACTACCAATTCGAGAAACAGATTCCTTAGTAGTTGC
TTCTGATATTGTCGGTAGAGATTTGGATGTTGCTGAGATAAAGGAGAAGATTTTGAAGATGAGAGAGGAGGATATT
GTTCTGTCCACCATTCCCATTGTAGGTATGGGAGGTTTAGGGAAAACAACTGTGGCTAAGAGGATTTACAATGATG
AACACATGAAGCAAATCTTTAAAAGAGAATTTGGTTGTGTCTACCTGAAATGTCTGAAACGAAGAGCTTTCTTGA
ACAAATCCTCGAATCGTTGATAGAGAGGAAAATTGAGGTTGAAAGGAGAGATATAATAGTCAAGAAGCTACAAGAT
GAATTGGAGGAAAAAAATATTTGCTAGTCCTGGATGATTTGTGGCGTGTTGACTCTACATCGTGGCATGAGTTCG
TCGACACCCTGAGGAGGAATAAATACATCCAGAGGAAACTGCATTCTTGTGACTACTTGTAGGAAGCAGGTGGCATC
CACAGTAGCAACAGATCTTCATATCTTGGGAAGTTAACAGAAGATCATTGTTGGTCTATTTTCAAACAAAAAGCA
TTTGTTGATGGCAGGGTTCCAGAGGAATTAGCGAGCATGGGCAACAAGATTGTTAAAATGTGCCAAGGTCTACCGT
TGGCTGCAAGTGCGTTGGGAGGGCTCTTACACAACAAAGAAAAACATGAATGGCAAGCAATTCTTGATGGCAACCT
CCTTGTTGCAGGTGAAGATGATAATGGAGAAAATAGCATAAAGAAAATCCTAAAACTCAGCTATGATTATCTACCA
TCTCCACATCTGAAAAAATGCTTTGCTTACTTTGCAATGTTTCCAAAAGATTATATGTTTGAAAAGGACCAACTAA
TCCAACTCTGGATGGCAGAAGGATTTCTTCGTCCAAGTCAAGAGATCCCTGTGATGGAAGACGTTGGGCACAGGTT
TTTTCAAATCTTGTTGCAGAATTCCTTGCTACAAGATGTTGTGTTAGATGAACACAACAATATAACACACTGTAAG
ATGCACGATCTTGTGCATGATTTGGCTGGAGATATCTTAAATCTAGACTATTTGATCCGAAGGGGCGACGATGGAG
AAAAACTTTCTCAAGTTCGATACTTTGGATGTGAGTCACCAACGGATCAAATAGATAAGATATATGAGCCAGAACG
TTTGTGCACACTGTTTTGGAGAAGCAATTATACATCTGAAGATATGCTGTTGAACTTTAAGTTCTTGAGAGTTTTA
GATTTGTCCAGTTCAGGAATCAAGGAGTTGTCAGCCAAAATCGGGAAGCTGATATACTTGAGATATCTTGATCTCT
CGAACACTGAGATCACAGCCTTGCCCAACTCCATTTGCAAGCTCTATAAATTGCAAACATTTAGAGTCATCAACTG
CTTTTCACTCCAGAAACTTCCATATGAGATGGAAATATGGTAAGTTTGAGACACATATATTACACTTCTGTTGAC
AAAAGAAATGAGCATTGGGGAGGATGGTGTATTCTCAATGAACGTTTTCAGATGCCACTTAAGATGCGACAATTAA
CTTGCTTCAAACCCTCAAGTTTTTCAAGATAGGTTTAAAGATTTGTCAAATAGAAGAATTAGGTCATTTGAA
AAACCTAAGAGGTGAATTGACGATCAATGGTCTCCAATTGGTCTGTGATAAAGAAGAGGCTCGAACAGCATATTTA
CACGATAAACCAAACATCTTCAAGCTGGCATTTTTATGGTCCCACGATGAATCAGAAGGCTGTGAGATCAATGATG
AGCATGTGTTGGATGGTCTTCAACCGCATCCTAACTTGAAAACCTTAGCAGTAGTGGACTATTTAGGGACTAAATT
TCCTTCATGGTTCAGTGAAGAGTCGCTACCAAATTTGGTTAAGTTGAAATTAAGTGGTAGCAAAAGGTGCAAGAA
ATTCCATCCCTTGGCCAACTGAAATTCCTTCGGCATCTTGAGCTGATAGGATTCCATGAGTTGGAATGCATTGGAC
CTGCTTTATATGGTGTTGAGATTAGAAATATTGGATCAAACAGCATTATCCAAGTGTTCCCGTCATTGAAAGAACT
AGTATTGGAGGATATGCGTAGCCTTATTGAGTGGAAGGGAGATGAAGTTGGAGTAAGAATGTTTCCTAGGCTTGAG
AAGTTGAGGGATTATGGAGTGTCCATTGTTAAAAAGTACTCCAAGTCAATTTGAAAGCCTGATGAATTAGACATTG
TCACAGTTGACAGTGAAATGCCATTGTTGAACTTGTGCAGCAACTTAACATCTCTCGTAGAGCTTAGCGTCTTTGC
TGTGAAAGAGCTCACTTGTTACCCGATGAGATGCTACGCAACAACGTTTCTCTTCAACAGATAACGATTTTCAAC
TGCGGAGAGTTTCGTGAATTGCCACAAAGCTTGTACAATCTCCATTCTCTGAGGAAATTAGGCATTTACAACTGCA
CCAATTTCAGTTCTCTTCCTGTTCCCAATGGAGACAACTATTTGACTTCCCTCCAACTCTTTTTCTTATATAATTG
TAATGGATTGATCAGTATACCAATTGGAATGCTAGATCAATGCCGGTCTCTAGAGTTTTGAATGTCAGCTGCTGT
AACAACTTGGTTTCATTCCCTTTACGTGTGTGGGAAATGCCTTCATTATTATTTTGGATATAACAGAATGTCCCA
AATTGATTAGTGTACCCAAAGTGGGCCTTCACCATCTCACTGGGTTATTGAGATTGGGAATTGGTCCTTTCTCAAA
```

FIG. 13S

```
GATGGTGGATTTTGATGCATTCCAATTGATTTTTAATGGCATTCAGCAGCTGTTGTCCCTTCGTGATCTGGAGGTG
TACGGACGTGGGCACTGGGATTCTCTGCCCTATCAGATTATGCAACTATCTGACCTAAGAGAGATCACAATAGCTG
ATTTTGGAATTGAGGCTCTTCCTCCTAGACTTGACAACCTTACTTCTCTTGAAAGCTTGACTCTAGTGAGGTGCAA
ACAGCTACAACATCTGAACTTCTCAGATGCCATGCCCAAATTACGGCTCCTGTGGATACGTGATTTTCCATTGTTA
GAAGCTCTGTCAGATGGGCTCGGCAACCTTGTTTCTTTGGAAGAATTATATTTACATGACTGCGAAAAACTAGAGC
ATCTACCGTCCCGAGATGCCATGCGATGCCTCACTAAATTATGGAACATGGGAATTAAAGGCTGCCCAAAGTTAGA
AGAAAGTTACACCAACTACTCCCAGTGGTCCAAAATTTCCCATATTTCAAATATTGAATTAGGTGGGAGGAGAAGT
ACAGCCGTAAGTCTCGGTTTCTCTTTCACTTTCTGA
```

FIG. 13T

Alignment Report of 'chc_allele-mining_total alignment proteins-
9-9 + chc homologs + RH homologs+Ph2candidate.meg'

```
                Majority       --------------------------------------------------
MNYCLPSSTLQTTTKRRLTLRRLCCKQLRKKTLVQIAEEEANTTMADPVIGATVQVLLE +---------+---------+---------+---------+---------+
                                 10        20        30        40
   50        60        70        80
                                 +---------+---------+---------+---------+
+---------+---------+---------+
94-2031_L4_L7_L8                 --------------------
MNYCLPSSTLQTTTKRRLTLRRLCCKQLRKKTLVQIAEEEANTTMADAVIGATVQVLLE          178
324-2_J1_J3_J8                   --------------------
MNYCLPSSTLQTTTKRRLTLRRLCCKQLRKKTLVQIAEEEANTTMADAVIGATVQVLLE          178
324-2_J2_J5_J6                   --------------------
MNYCLPSSTLQTTTKRRLTLRRLCCKQLRKKTLVQIAEEEANTTMADAVIGATVQVLLE          178
487-1_I4_I6_I8                   --------------------
MNYCLPSSTLQTTTKRRLTLRRLCCKQLRKKTLVQIAEEEANTTMADAVIGATVQVLLE          178
493-5_F1_F5_F7                   --------------------
MNYCLPSSTLQTTTKRRLTLRRLCCKQLRKKTLVQIAEEEANTTMADAVIGATVQVLLE          178
493-7_G2                         --------------------
MNYCLPSSTLQTTTKRRLTLRRLCCKQLRKKTLVQIAEEEANTTMADAVIGATVQVLLE          178
493-7_G10                        --------------------
MNYCLPSSTLQTTTKRRLTLRRLCCKQLRKKTLVQTAEEEANTTMADPVIGATVQVLLE          178
493-7_G12                        --------------------
MNYCLPSSTLQTTTKRRLTLRRLCCKQLRKKTLVQIAEEEANTTMADAVIGATVQVLLE          178
493-7_G14_G22                    --------------------
MNYCLPSSTLQTTTKRRLTLRRLCCKQLRKKTLVQIAEEEANTTMADAVIGATVQVLLE          178
493-7_G19                        --------------------
MNYCLPSSTLQTTTKRRLTLRRLCCKQLRKKTLVQIAEEEANTTMADAVIGATVQVLLE          178
493-7_G21                        --------------------
MNYCLPSSTLQTTTKRRLTLRRLCCKQLRKKTLVQIAEEEANTTMADAVIGATVQVLLE          178
493-9_H5_H30                     --------------------
MNYCLPSSTLQTTTKRRLTLRRLCCKQLRKKTLVQIAEEEANTTMADAVIGATVQVLLE          178
493-9_H11_H19_H27                --------------------
MNYCLPSSTLQTTTKRRLTLRRLCCKQLRKKTLVQTAEEEANTTMADAVIGATVQVLLE          178
543-5_C2                         --------------------
MNYCLPSSTLQTTTKRRLTLRRLCCKQLRKKTLVQIAEEEANTTMADAVIGATVQVLLE          178
561-2_K4_K14_K22                 --------------------
MNYCLPSSTLQTTTKRRLTLRRLCCKQLRKKTLVQIAEEEANTTMADAVIGATVQVLLE          178
561-2_K6_K30_K31                 --------------------
MNYCLPSSTLQTTTKRRLTLRRLCCKQLRKKTLVQIAEEEANTTMADAVIGATVQVLLE          178
849-1_M8_M18_M20                 --------------------
MNYCLPSSTLQTTTKRRLTLRRLCCKQLRKKTLVQTAEEEANTTMADPVIGATVQVLLE          178
852-5_E14_E23                    --------------------
MNYCLPSSTLQTTPKRKLTLRRLWCKQLRKKTLVQTAEEEANTTMADPVIGATVQVLLE          178
852-5_E28                        --------------------
MNYCLPSSTLQTTTKRRLTLRRLCCKQLRKKTLVQTAEEEANTTMADAVIGATVQVLLE          178
852-5_E30                        --------------------
MNYCLPSSTLQTTPKRKLTLRRLWCKQLRKKTLVQTAEEEANTTMADPVIGATVQVLLE          178
RH_D3_D4_D7                      --------------------
MNYCLPSSTLQTTTKRRLTLRRLCCIQLRKKTLVQIAEEEANTTMADPVIGATVQVLLE          179
Rpi-chc1_ORF                     --------------------
MNYCLPSSTLQTTTKRRLTLRRLCCKQLRKKTLVQTAEEEANTTMADPVIGATVQVLLE          178
chc1_BAC_B07-1C15                --------------------
---------------MADPVIGATVQVLLD           43
chc2_BAC_B07-1C15                --------------------
---------------MADPVIGATVQVLLE           43
chc_RGC1_BAC_2D06-3D21           --------------------
---------------MADPVIGATVQVLLE           43
chc_RGC2_BAC_2D06-3D21           --------------------
---------------MADPVIGATVQVLLE           43
```

FIG. 14A

```
RH122B15 c247                 ------------------------------------------
---------------MADPVIGATVQVVLE      43
RH122B15 c88-5                ------------------------------------------
---------------MADPVIGATVQVLLE      43
RH137D14 c13-1
MRMRKIICWTYALIKWLGIGIYLTRHQRSGSKKTKTKRRHRVGHTVGMQKKTFLRRRFCEGANATMADPVTGATVQ
VLVD        238
RH137D14 c13-2                ------------------------
MNYCLPLSTLQTTTKRRLTLRRLCCIQLRKKTLVQIABEEEANTTMADPVIGATVQVLLE       178
RH77023 c579-4                ------------------------------------------
---------------MADPVFAATVKVLLD      43
RH77023 c579-5                ------------------------------------------
---------------MADPVIGATVQVVLE      43
RH77023 c671                  ------------------------------------------
---------------MADPVIGATVQVVLE      43
RH77023 c706-3                ------------------------------------------
---------------MADPVIGATVQVVLE      43
RH77023 c706-4                ------------------------------------------
---------------MADPVIGATVQVLLE      43
ph2 candidate                 ------------------------------------------
---------------MADPVIGATVQVLLE      15

Majority     KLISLTIEEVNSSRDFNKDLEMLTQNVSLIQAFIHDVETPQ-
EKQQSVEQWLNRLERVAEDAENVFDRFRYESLK--TKV 90        100       110       120       130
     140       150       160

94-2031_L4_L7_L8          KLISLTIEEVNSSRDFNKDLEMLTQNVSLIQAFIHDVETPQ-
EKQQSVEQWLNRLERVAEDAENVFDRFRYESLK--TKV       409
324-2_J1_J3_J8            KLISLTIEEVNSSRDFNKDLEMLTQNVSLIQAFIHDVETPQ-
EKQQSVEQWLNRLERVAEDAENVFDRFRYESLK--TKV       409
324-2_J2_J5_J6            KLISLTIEEVNSSRDFNKDLEMLTQNVSLIQAFIHDVETPQ-
EKQQSVEHWLNRLERVAEDAENVFDRFRYESLK--TKV       409
487-1_I4_I6_I8            KLISLTIEEVNSSRDFNKDLEMLTQNVSLIQAFIHDVETPQ-
EKQQSVEQWLNRLERVAEDAENVFDRFRYESLK--TKV       409
493-5_F1_F5_F7            KLISLTIEEVNSSRDFNKDLEMLTQNVSLIQAFIHDVETPQ-
EKQQSVEHWLNRLERVAEDAENVFDRFRYESLK--TKV       409
493-7_G2                  KLISLTIEEVNSSRDFNKDLEMLTQNVSLIQAFIHDVETPQ-
EKQQSVEQWLNRLERVAEDAENVFDRFRYESLK--TKV       409
493-7_G10                 KLISLTIEEVNSSRDFNKDLEMLTQNVSLIQAFIHDVETPQ-
EKQQSVEQWLNRLERVAEDAENVFDRFRYESLK--TKV       409
493-7_G12                 KLISLTIEEVNSSRDFNKDLEMLTQNVSLIQAFIHDVETPQ-
EKQQSVEHWLNRLERVAEDAENVFDRFRYESLK--TKV       409
493-7_G14_G22             KLISLTIEEVNSSRDFNKDLEMLTQNVSLIQAFIHDVETPQ-
EKQQSVEQWLNRLERVAEDAENVFDRFRYESLK--TKV       409
493-7_G19                 KLISLTIEEVNSSRDFNKDLEMLTQNVSLIQAFIHDVETPQ-
EKQQSVEQWLNRLERVAEDAENVFDRFRYESLK--TKV       409
493-7_G21                 KLISLTIEEVNSSRDFNKDLEMLTQNVSLIQAFIHDVETPQ-
EKQQSVEHWLNRLERVAEDAENVFDRFRYESLK--TKV       409
493-9_H5_H30              KLISLTIEEVNSSRDFNKDLEMLTQNVSLIQAFIHDVETPQ-
EKQQSVEQWLNRLERVAEDAENVFDRFRYESLK--TKV       409
493-9_H11_H19_H27         KLISLTIEEVNSSRDFNKDLEMLTQNVSLIQAFIHDVETPQ-
EKQQSVEHWLNRLERVAEDAENVFDRFRYESLK--TKV       409
543-5_C2                  KLISLTIEEVNSSRDFNKDLEMLTQNVSLIQAFIHDVETPQ-
EKQQSVEQWLNRLERVAEDAQNVFDRFIYESLK--TKV       409
561-2_K4_K14_K22          KLISLTIEEVNSSRDFNKDLEMLTQNVSLIQAFIHDVETPQ-
EKQQSVEQWLNRLERVAEDAENVFDRFRYESLK--TKV       409
561-2_K6_K30_K31          KLISLTIEEVNSSRDFNKDLEMLTQNVSLIQAFIHDVETPQ-
EKQQSVEQWLNRLERVAEDAENVFDRFRYESLK--TKV       409
```

FIG. 14B

```
849-1_M8_M18_M20          KLISLTIEEVNSSRDFNKDLEMLTQNVSLIQAFIHDVETPQ-
EKQQSVEQWLNRLERVAEDAENVFDRFRYESLK--TKV         409
852-5_E14_E23
KLISLTIEDVNSSRDFNKDLEMLTQNVSLIQAFIHDVKTPQVEKQQSFEQWLNRLERVAEDAQNVFDRFRYESLK-
-TKV          412
852-5_E28                 KLISLTIEDVNSSRDFNKDLEMLTQNVSLIQAFIHDVETPQ-
EKQQSVEQWLNRLERVAEDAENVFDRFRYESLK--TKV         409
852-5_E30
KLISLTIEDVNSSRDFNKDLEMLTQNVSLIQAFIHDVKTPQVEKQQSFEQWLNRLERVAEDAQNVFDRFRYESLK-
-TKV          412
RH_D3_D4_D7               KLISLTIEEVNSSRDFNKDLEMLTQNVSLIQAFIHDVETPQ-
EKQQSVEQWLNRLERVAEDAENVFDRFRYESLK--TKV         409
Rpi-chc1_ORF              KLISLTIEEVNSSRDFNKDLEMLTQNVSLIQAFIHDVETPQ-
EKQQSVEQWLNRLERVAEDAQNVFDRFIYESLK--TKV         409
chc1_BAC_B07-1C15         KLLSLTIEEFSSSRDCNKDLEMLTQNVSLIQAFIHDAERRQ-
VEDKAVKLWLNRLDRAAENAEYVFDKFRYESLKRQVKI         280
chc2_BAC_B07-1C15         KLISLTIEEFSSSRDCNKDLRMLTQNVSMIQAFIHDGERRQ-
VEDQSVKLWFTRLERAAENAENVFDKFRYESLKRQVKI         280
chc_RGC1_BAC_2D06-3D21    KLLSLTIEEFNSSRDCNKDLGMLTQNVSMIQAFIHDAERRQ-
VEDQAVKLWLNRLERAAENAENVFDKFRYESLKRQVKI         280
chc_RGC2_BAC_2D06-3D21    KLLSLTIEEFSSSRDCNKDLRMLTQNVSMIQAFIHDAERRQ-
VEDQSMKLWFTRLERAAENAENVFDKFRYESLKRQVKI         280
RH122B15_c247             KLLSLTIEEARNLRNCKKNLRMLSRYVTMIQAFIHDAERRQVED-
RAVEEWLKMLERIAEDAENVFDKFTYESIK--AKV            274
RH122B15_c88-5            KLISLTIEEVNSSRDFNKDLEMLT-----------------
QFDKQQSVEQWLNRLERVAEDAQNVFDRFRYESLK--TKV       229
RH137D14_c13-1            KLLSLTIEEFSSSRDCNKDLEMLTQNVSLIQAFIHDAERRQ-
VEDQSVKVWLNSLERAAENAEYVCDKFRYESLKRQVKI         475
RH137D14_c13-2            KLISLTIEEVNSSRDFNKDLEMLTQNVSLIQAFIHDVETPQ-
EKQQSVEQWLNRLERVAEDAENVFDRFRYESLK--TKV         409
RH77O23_c579-4
KLISLTIKEISSSRDFNEDLEMLTHNVSLIQAFLHDVETPQVEKQQSVEQWLRRLERVAENAENVFDRFRYESLK-
-TKV          277
RH77O23_c579-5            KLLSLTIEEARSLRNCKKNLRMLSRYVTMIQAFIHDAERRQ------
VEEWLKMLERIAEDAENVFDKFTYESIK---AKV             259
RH77O23_c671              KLLSLTIEEARNVRNCKKNLRMLSRYVTMIQAFIHDAERRQVED-
RAVEEWLKMLERIAEDAENVFDKFTYESIK--AKV            274
RH77O23_c706-3            KLLSLTIEEVKRLGNCKKDLEMLTKNVSLIQAFIHDAERRQ-
VEDQVVEQWLKMLERVTENAENVFDRFRYESLKRQVKI         280
RH77O23_c706-4
KLISLTIEEVNSSRDFNKDLEMLTQNASLIQAFIHDVETPQVEKQQSVEQWLYRLERVAEDAQNVFDRFRYESLK-
-TKV          277
ph3 candidate
KLLSLSIEEVKTLRNCKKNLSKLTKHVTMIQAYTHDAETRQVEDNQAVEEWLKMLEKIAEDAENVFDKFTYVSIK-
-ARV          93

Majority       VR---
SPLKKVSGFFSHTAFKRKMSQKINNINKELTAINKVAKDLGLQSLMVPSRKILPIRETDSFVVASDVVGRDLDVA
+---------+---------+---------+---------+---------+---------+---------+
                                        170       180       190       200
210       220       230       240
                                 +---------+---------+---------+---------+
94-2031_L4_L7_L8          VR---
SPLKKVSGFFSHTAFKRKMSQKINNINKELTAINKVAKDLGLQSLMVPSWKILPIRETDSFVGASDVVGRDLDVA
640
324-2_J1_J3_J8            VR---
SPLKKVSGFFSHTAFKRKMSQKINNINKELTAINKVAKDLGLQSLMVPSWKILPIRETDSFVGASDVVGRDLDVA
640
```

FIG. 14C

```
324-2_J2_J5_J6              VR---
SPLKKVSGFFSHTAFKRKMSQKINNINKELTAINKVAKDLGLQSLMVPSRKILPIRETDSFVGASDVVGRDLDVA
640
487-1_I4_I6_I8              VR---
SPLKKVSGFFSHTAFKRKMSQKINNINKELTAINKVAKDLGLQSLMVPSRKILPIRETDSLVVASDIVGRDLDVA
640
493-5_F1_F5_F7              VR---
SPLKKVSGFFSHTAFKRKMSQKINNINKELTAINKVAKDLGLQSLMVPSRKILPIRETDSFVGASDVVGRDLDVA
640
493-7_G2                    VR---
SPLKKVGGFFSHTAFKRKMSQKINNINKELTAINKVAKDLGLQSLMVPSRKILPIRETDSLVVASDIVGRDLDVA
640
493-7_G10                   VR---
SPLKKVGGFFSHIAFKRKMSQKINNINKELTAINKVAKDLGLQSLMVPSRKILPIRETDSLVVASDIVGRDLDVA
640
493-7_G12                   VR---
SPLKKVSGFFSHTAFKRKMSQKINNINKELTAINKVAKDLGLQSLMVPSRKILPIRETDSFVGASDVVGRDLDVA
640
493-7_G14_G22               VR---
SPLKKVGGFFSHTAFKRKMSQKINNINKELTAINKVAKDLGLQSLMVPSRKILPIRETDSLVVASDIVGRDLDVA
640
493-7_G19                   VR---
SPLKKVGGFFSHTAFKRKMSQKINNINKELTAINKVAKDLGLQSLMVPSRKILPIRETDSLVVASDIVGRDLDVA
640
493-7_G21                   VR---
SPLKKVSGFFSHTAFKRKMSQKINNINKELTAINKVAKDLGLQSLMVPSRKILPIRETDSFVGASDVVGRDLDVA
640
493-9_H5_H30                VR---
SPLKKVSGFFSHTAFKRKMSQKINNINKELTAINKVAKDLGLQSLIVPSRKILPIRETDSIVGASDVVGRDLDVA
640
493-9_H11_H19_H27           VR---
SPLKKVSGFFSHTAFKRKMSQKINNINKELTAINKVAKDLGLQSLMVPSRKILPIRETDSFVGASDVVGRDLDVA
640
543-5_C2                    VR---
SPLKKVSGFFSHTAFKRKMSQKINNINKELTAINKVAKDLGLQSLMVPSRKILPIRETDSFVVASDIVGRDLDIA
640
561-2_K4_K14_K22            VR---
SPLKKVSGFFSHTAFKRKMSQKINNINKELTAINKVAKDLGLQSLMVPSWKILPIRETDSFVGASDVVGRDLDVA
640
561-2_K6_K30_K31            VR---
SPLKKVGGFFSHTAFKRKMSQKINNINKELTAINKVAKDLGLQSLMVPSRKILPIRETDSLVVASDIVGRDLDVA
640
849-1_M8_M18_M28            VR---
SPLKKVGGFFSHTAFKRKMSQKINNINKELTAINKVAKDLGLQSLMVPSRKILPIRETDSLVVASDIVGRDLDVA
640
852-5_E14_E23               VR---
SPLKKVSGFFSHSAFKRKMSQNINNINKELTAINKVAKDLGLQSLMVPSRKILPIRETDSFVGASDVVGRDLDVA
643
852-5_E28                   VR---
SPLKKVSGFFSHTAFKRKMSQKINNINKELTAINKVAKDLGLQSLMVPSRKILPIRETDSFVGASDVVGRDLDVA
640
852-5_E30                   VR---
SPLKKVSGFFSHSAFKRKMSQNINNINKELTAINKVAKDLGLQSLMVPSRKILPIRETDSFVGASDVVGRDLDVA
643
RH_D3_D4_D7                 VR---
SPLKKVGGFFSHTAFKRKMSQKINNINKELTAINKVAKDLGLQSLMVPSRKILPIRETDSLVVASDIVGRDLDVA
640
Rpi-chc1_ORF                VR---
SPLKKVSGFFSHTAFKRKMSQKINNINKELTAINKVAKDLGLQSLMVPSRKILPIRETDSFVVASDIVGRDLDIA
640
chc1_BAC_B07-1C15           RN---
NPMRKVSDFFSHTAFKNKMSRKINNINERLRAINKVAKTLGLQALMVPPQKILPIRETDSIVVASYVVGRDNDVA
511
```

FIG. 14D

```
chc2_BAC_B07-1C15          RN---
NPMRKVSDFFSHTAFKNKMSRKINNINEELRVINKVAKNLSLQSLMVPPRKILPIRETDSIVAASYVVGRDKDVA
511
chc_RGC1_BAC_2D06-3D21     RN---
NPMRKVSDFFSHTAFKNKMSRKVNNINEELRGINMLAKDLGLQSFMVPPRKILPIRETDSIVVASYIVGREKDVA
511
chc_RGC2_BAC_2D06-3D21     RN---
NPMRKVSDFFSHTAFKNKMSRKINNINEELRAINTVAKNLGLQSLMVPPRKILPIQETDSIVVASYVVGRDNDVA
511
RH122B15 c247
MNNRAKLMEKVSHLFSHTAFKYKMSRKINKINEELRDINQLANNLGLQSLTVPSRKILQIRETDSAVVPSDVVGRD
KDVA            514
RH122B15 c88-S             MS---
SPMKKVSGFFSHTAFKRKISRKINNINKEVTAINKVAKDLGLQSPMVPSRKILPIRETDSLVVASDVVGRDLDVA
460
RH137D14 c13-1             RN---
NPMRKVSDFFSHTAFKNKMSRKINNINEELRAIYKVAKTLGLQALMVPPRKILPIRETDSIVVASYVVGRDNDVA
706
RH137D14 c13-2             VR---
SPLKKVGGFFSHTAFKRKMSQKINNINKELTAINKVAKDLGLQSLMVPSRKILPIRETDSLVVASDIVGRDLDVA
640
RH77023 c579-4
INIRNSPMKKVSGFFSHTAFKSKMSRKINSINKELTAINKVAKDLGLHSLIVPSRKILPIRETDSIVVASDVVGRD
LDVA            517
RH77023 c579-5
MNNRAKLMEKVSHFFSHTAFKYKMSRKINKINEELRDINQLANNLGLQSLTVPSRKILQIRETDSAVVPSDVVGRD
KDVA            499
RH77023 c671
MNNRAKLMEKVSHFFSHTAFKYKMSRKINKINEELRDINQLANNLGLQSLTAPSRKILQIRETDSAVVPSDVVGRD
KDVA            514
RH77023 c706-3             RN---
NPMKKVSDFFSHTDFKRRMSRKINNINEELRAINKLANDLGLQSLMVPPRQILPIRETDSVVVASDVVGRDKDVA
511
RH77023 c706-4
RSIRNSPMKKVSGFFSHTAFKRKMSQKINNINKELTAINKVAKDLGLQSLMVPSRKILPIRETDSLVVASDVVGRD
MDVA            517
ph2 candidate
MKNQRKLMEKVSHFPSQTVFKYRMSRKINDINEELRAINELANNLGLQLLTVPSRKIPQIRETDSS--
ASYVVGRDKDVA                171

Majority
EIKEKILKMREEDVVLSTIPIVGMGGLGKTTVAKRIYNDEHIKQIFKKRIWLCLPEMSETKSFLEQILESLIERKI
EVER 250       260       270       280
       290       300       310       320

94-2031_L4_L7_L8
EIKEKILNMREEDVVLSTIPIVGMGGLGKTTVAKRIYNDEHIKQIFKERIWLCIPEMSETKSFLQQILESLIERKI
EVER            880
324-2_J1_J3_J8
EIKEKILNMREEDVVLSTIPIVGMGGLGKTTVAKRIYNDEHIKQIFKERIWLCIPEMSETKSFLQQILESLIERKI
EVER            880
324-2_J2_J5_J6
EIKEKILKMREEDVVLSTIPIVGMGGLGKTTVAKRIYNDEHIKQIFKERIWLCIPEMSETKSFLEQILESLIERKI
EVER            880
487-1_I4_I6_I8
EIKEKILKMREEDIVLSTIPIVGMGGLGKTTVAKRIYNDEHMKQIFKKRIWLCLPEMSETKSFLEQILESLIERKI
EVER            880
```

FIG. 14E

```
493-5_F1_F5_P7
EIKEKILKMREEDVVLSTIPIVGMGGLGKTTVAKRIYNDEHIKQIFKERIWLCIPEMSETKSFLEQILESLIERKI
EVER    880
493-7_G2
EIKEKILKMREEDIVLSTIPIVGMGGLGKTTVAKRIYNDEHMKQIFKKRIWLCLPEMSETKSFLEQILESLIERKI
EVER    880
493-7_G10
EIKEKILKMREEDIVLSTIPIVGMGGLGKTTVAKRIYNDEHMKQIFKKRIWLCLPEMSETKSFLEQILESLIERKI
EVER    880
493-7_G12
EIKEKILKMREEDVVLSTIPIVGMGGLGKTTVAKRIYNDEHIKQIFKERIWLCIPEMSETKSFLEQILESLIERKI
EVER    880
493-7_G14_G22
EIKEKILKMREEDIVLSTIPIVGMGGLGKTTVAKRIYNDEHMKQIFKKRIWLCLPEMSETKSFLEQILESLIERKI
EVER    880
493-7_G19
EIKEKILKMREEDIVLSTIPIVGMGGLGKTTVAKRIYNDEHMKQIFKKRIWLCLPEMSETKSFLEQILESLIERKI
EVER    880
493-7_G21
EIKEKILKMREEDVVLSTIPIVGMGGLGKTTVAKRIYNDEHIKQIFKERIWLCIPEMSETKSFLEQILESLIERKI
EVER    880
493-9_H5_H30
EIKEKILKMREEDVVLSTIPIVGMGGLGKTTVAKRIYNDEHIKQIFKERIWLCIPEMSETKSFLEQILESLIERKI
EVER    880
493-9_H11_H19_H27
EIKEKILKMREEDVVLSTIPIVGMGGLGKTTVAKRIYNDEHIKQIFKERIWLCIPEMSETKSFLEQILESLIERKI
EVER    880
543-5_C2
EIKEKILNMREEDIVLSTIPIVGMGGLGKTTVAKRIYNDEHMKQIFEKRIWLCLPEMSETKSFLEQILESLIERKI
EVER    880
561-2_K4_K14_K22
EIKEKILNMREEDVVLSTIPIVGMGGLGKTTVAKRIYNDEHIKQIFKERIWLCIPEMSETKSFLQQILESLIERKI
EVER    880
561-2_K6_K30_K31
EIKEKILKMREEDIVLSTIPIVGMGGLGKTTVAKRIYNDEHMKQIFKKRIWLCLPEMSETKSFLQQILESLIERKI
EVER    880
849-1_M8_M18_M20
EIKEKILNMREEDIVLSTIPIVGMGGLGKTTVAKRIYNDEHMKQIFKKRIWLCLPEMSETKSFLEQILESLIERKI
EVER    880
852-5_E14_E23
EIKEKILKMREEDVVLSTIPIVGMGGLGKTTVAKRIYNDEHIKQIFKERIWLCIPEMSETKSFLEQILESLIERKI
EVER    883
852-5_E28
EIKEKILKMREEDVVLSTIPIVGMGGLGKTTVAKRIYNDEHMKQIFKKRIWLCLPEMSETKSFLEQILESLIERKI
EVER    880
852-5_E30
EIKEKILKMREEDVVLSTIPIVGMGGLGKTTVAKRIYNDEHIKQIFKERIWLCIPEMSETKSFLEQILESLIERKI
EVER    883
RH_D3_D4_D7
EIKEKILKMREEDIVLSTIPIVGMGGLGKTTVAKRIYNDEHMKQIFKKRIWLCLPEMSETKSFLEQILESLIERKI
EVER    880
Rpi-chc1_ORF
EIKEKILNMREEDIVLSTIPIVGMGGLGKTTVAKRIYNDEHMKQIFEKRIWLCLPEMSETKSFLEQILESLIERKI
EVER    880
chc1_BAC_B07-1C15        EIKRKMLNIR-
DDVVLCTIPIVGMGGLGKTTVAKIIFNDEQIEKHFEKRVWLCLPEMSEIKSFLELILESLTERKLEVQS
748
chc2_BAC_B07-1C15        EIKEKIFTIR-
EDIDLCTIPIVGMGGLGKTTVAKRIFNDEQIEKHFEKRVWLCLPEMSEIKSFLELILESLTERKLEVQS
748
chc_RGC1_BAC_2D06-3D21   EIKEKILTIR-
EDIDLCTIPIVGMGGLGKTTVAKRIFNDEQIEKHFEKRVWLCQPEMSETKSFLELILESLTERKVEVLS
748
```

FIG. 14F

```
cho_RGC2_BAC_2D06-3D21      EIKEKILTIR-
EDIDLCTIPIVGIGGLGKTTVAKRIFNDEQIEKHFEKRVWLCLPEMSEIKSFLELILESLTKRKVEVQG
748
RH122B15 c247               EIKGKILNMR-
KDAVLCTIPIVGMGGLGKTTLAKRIFNDQHIEKHFEKRIWLCIPEMSEIKSFLELILESLTERKVEVQS
751
RH122B15 c88-5
VIKEKILNMRKEDVVLSTIPIVGMGGLGKTTMAKRIYNDEHIKQAFEKRIWLCLPEMSETKSFLEQILESLTERKF
EVER    700
RH137D14 c13-1              EIKRKMLNIR-
DDVVLCTIPIVGMGGLGKTTVAKRIFNDEQIEKHFEKRVWLCLPEMSEIKSFLELILESLTERKLEVQS
943
RH137D14 c13-2
EIKEKILKMREEDIVLSTIPIVGMGGLGKTTVAKRIYNDEHMKQIFKKRIWLCLPEMSETKSFLEQILESLIERKI
EVER    880
RH77023 c579-4
EIKEKILKMREEDVVMCTIPIVGMGGLGKTTVAKRIYNDEHIKQIFERRIWLCLPEMSETKSFLEQILESLTERKV
EVQR    757
RH77023 c579-5              EIKEKILNMR-
KDAVLCTIPIVGMGGLGKTTLAKRIFNDQHIEKHFEKRIWLCLPEMSEIKSFLELILESLTERKVEVQS
736
RH77023 c671                VIKEKILNMR-
KDAVLCTIPIVGMGGLGKTTLAKRIFNDQHIEKHFENRIWLCLPEMSEIKNFLELILESLTERKVEVQS
751
RH77023 c706-3              EIKEKILTMR-
DDIDLCTIPIVGMGGLGKTTVAKRVFNDEQIEKHFEKRVWLCLPEMSETKSFLELILESLTERKLEVQS
746
RH77023 c706-4
EIKEKILKMREEDAVLCTIPIVGMGGLGKTTVAKRIYNDEHIKQIFEKRIWLCLPEMSEIMIFLEQILESLTEKKV
EVQR    757
ph2 candidate               EVKEKILNMR-
KDVVLCTIPIVGMGGLGKTTLVKRIFNDVEIEKHFVKRVWLCLPEMSDAKSFLELILRSLTGQKLELQS
250

Majority
RDIIVKKLQDELGGKKYLLVLDDLWRVDSTSWHEFVDTLRGINTSRGNCILVTTRMKQVASTVATDL--
HILGKLTEDHC 330       340       350      360
 370      380       390       400

94-2031_L4_L7_L8
RDIIVKKLQDELGGKKYLLVLDDLWRVDSTSWHEFVDTLRGINTSRGNCILVTTRRKQVASTVATDL--
HILGKLTEDHC       1114
324-2_J1_J3_J8
RDIIVKKLQDELGGKKYLLVLDDLWRVDSTSWHEFVDTLRGINTSRGNCILVTTRRKQVASTVATDL--
HILGKLTEDHC       1114
324-2_J2_J5_J6
RDIIVKKLQDELGGKKYLLVLDDLWRVDSTSWHEFVDTLRGINTSRGNCILVTTRMKRVASTVATDL--
HILGKLTEDHC       1114
487-1_I4_I6_I8
RDIIVKKLQDELGGKKYLLVLDDLWSVDSTLWHEFVDTLRGINTSRGNCILVTTRRKQVASTVATDL--
HILGKLTEDHC       1114
493-5_F1_F5_F7
RDIIVKKLQDELGGKKYLLVLDDLWRVDSTSWHEFVDTLRGINTSRGNCILVTTRMKRVASTVATDL--
HILGKLTEDHC       1114
493-7_G2
RDIIVKKLQDELGGKKYLLVLDDLWRVDSTSWHEFVNTLRGINTSRGNCILVTTRMKWVASTVATDL--
HILGKLTEDHC       1114
```

FIG. 14G

```
493-7_G10
RDIIVKKLQDELGGKKYLLVLDDLWRVDSTSWHEFVDTLRGINTSRGNCILVTTCRKQVASTVATDL--
HILGKLTEDHC        1114
493-7_G12
RDIIVKKLQDELGGKKYLLVLDDLWRVDSTSWHEFVDTLRGINTSRGNCILVTTRMKRVASTVATDL--
HILGKLTEDHC        1114
493-7_G14_G22
RDIIVKKLQDELGGKKYLLVLDDLWRVDSTSWHEFVNTLRGINTSRGNCILVTTRMKWVASTVATDL--
HILGKLTEDHC        1114
493-7_G19
RDIIVKKLQDELGGKKYLLLLDDLWRVDSTSWHEFVNTLRGINTSRGNCILVTTRMKWVASTVATDL--
HILGKLTEDHC        1114
493-7_G21
RDIIVKKLQDELGGKKYLLVLDDLWRVDSTSWHEFVDTLRGINTSRGNCILVTTRMKRVASTVATDL--
HILGKLTEDHC        1114
493-9_H5_H30
RDIIVKKLQDELGGKKYLLVLDDLWRVDSTSWHEFVNTLRGINTSRGNCILVTTRMKWVASTVATDL--
HILGKLTEDHC        1114
493-9_H11_H19_H27
RDIIVKKLQDELGGKKYLLVLDDLWRVDSTSWHEFVDTLRGINTSRGNCILVTTRMKRVASTVATDL--
HILGKLTEDHC        1114
543-5_C2
RDIIVKKLQDELGGKKYLLVLDDLWCVDSTSWHEFIDTLRGINTSRGNCILVTTRRKQVASTVATDL--
HILGKLTEDHC        1114
561-2_K4_K14_K22
RDIIVKKLQDELGGKKYLLVLDDLWRVDSTSWHEFVDTLRGINTSRGNCILVTTRRKQVASTVATDL--
HILGKLTEDHC        1114
561-2_K6_K30_K31
RDIIVKKLQDELGGKKYLLVLDDLWRVDSTSWHEFVNTLRGINTSRGNCILVTTRMKWVASTVATDL--
HILGKLTEDHC        1114
849-1_M8_M18_M20
RDIIVKKLQDELGGKKYLLVLDDLWRVDSTSWHEFVDTLRGINTSRGNCILVTTRRKQVASTVATDL--
HILGKLTEDHC        1114
852-5_E14_E23
RDIIVKKLQDELGGKKYLLVLDDLWRVDSTSWHEFVDTLRGINTSRGNCILVTTRRKQVASTVATDL--
HILGKLTEDHC        1117
852-5_E28
RDIIVKKLQDELGGKKYLLVLDDLWRVDSTSWHEFVDTLRGINTSRGNCILVTTRRKQVASTVATDL--
HILGKLTEDHC        1114
852-5_E30
RDIIVKKLQDELGGKKYLLVLDDLWRVDSTSWHEFVDTLRGINTSRGNCILVTTRRKQVASTVATDL--
HILGKLTEDHC        1117
RH_D3_D4_D7
RDIIVKKLQDELGGKKYLLVLDDLWRVDSTSWHEFVDTLRRINTSRGNCILVTTRRKQVASTVATDL--
HILGKLTEDHC        1114
Rpi-chc1_ORF
RDIIVKKLQDELGGKKYLLVLDDLWCVDSTSWHEFIDTLRGINTSRGNCILVTTRRKQVASTVATDL--
HILGKLTEDHC        1114
chc1_BAC_B07-1C15
RDIIVKKLRDELAGRKYLLVLDDLWHVDPTLWDEFVETLRGINTSRGNIILVTTRMELVASTVAAVLGPHMLEKLA
EDHC        988
chc2_BAC_B07-1C15
RDIIVKKLRDELAGKKYLIVLDDLWSVDPTLWDEFVDTLRGINTSRGNFILVTTRMELVASTVAAVPGPHKLEKLA
EDHC        988
chc_RGC1_BAC_2D06-3D21
RDIIVKKLRDELAGRKYLLVLDDLWGVDSTLWDEFVDTLRGINTSRGNFILVTTRMELVASTVAAVLGPHKLEKLS
EDHC        988
chc_RGC2_BAC_2D06-3D21
RDIIAKKLQDELAGRKYLLVLDDLWRVDPTLWDEFVDTLRGINTSRGNFILVTTRMKLVASTVATVLGPHMLEKLS
EDHC        988
RH122B15_c247
RDIIVKKLRDALGEKQYLLVLDDLWRVDSTSWHEFLDTLRGINTSRGNCILVTTRSKQVASIVAADL--
HKLGKLTDDHC        985
```

FIG. 14H

```
RH122B15 c88-5
RDIIVKKLQDELGGKKYLLVLDDLWHVDFTSWHEFVDTLRGINTSRGNCILVTTRMKRVASTVATDL--
HMLGKLTEDHC      934
RH137D14 c13-1
RDIIVKKLRDELAGGKYLLVLDDLWRVDPTLWDEFVDTLRGINTSRGNFIIVTTRMELVASTVAPVLGPHMLEKLS
EDHC            1183
RH137D14 c13-2
RDIIVKKLQDELGGKKYLLVLDDLWRVDSTSWHEFVDTLRRINTSRGNCILVTTRRKQVASTVATDL--
HILGKLTEDHC     1114
RH77023 c579-4
RDIIVKKLQDKLGGKNYLLVLDDLWCVDSTSWHEFVDTLRGINTAKGNCILVTTRMKRVASTVAADL--
HMLGKLTEDHC      991
RH77023 c579-5
RDIIVKKLRDALGEKQYFLVLDDLWRVDYTLWHEFLDTLRGINTSRGNCILVTTRSKQVASIVAADL--
HKLGKLTDDQC      970
RH77023 c671
RDIIVKKLRAALGEKQYLLVLDDLWRADSTSWHEFLDTLRGINTSRGNCILVTTRSKQVASIVAEDL--
HKLGKLTDDHC      985
RH77023 c706-3
RDIIVKKLRDELAGRKYLLVLDDLWRDPTLWHEFLDTLRGINTTRGNCILVTTRMKLVASTVAVGL--
HMLGKLADDHC      982
RH77023 c706-4
RDIIVKKLQDELGGKNYLLVLDDLWRLDSTSWHEFVDTLRGINTSRGNCILVTTRMKRVASTIATNL--
HILGKLTEDHC      991
ph2 candidate
RDIIVKKLQDALGEKRYLLVLDDLWRVGSTHWYEFMDTLKGINTSRGNCILVTTRMKQVASIVAADL--
HMLGKLADDHC      328

Majority
WSIFKQKAFVDGRVPEELASMGNKIVKMCQGLPLAASVLGGLLHNKEKHEWQAILDGNLLVAGEDDNGENSIKKIL
KLSY ----------+----------+----------+----------+----------+
                                        410       420       430       440
----------+----------+----------+----------+
   450       460       470       480
                                        ----------+----------+----------+----------+
----------+----------+----------+----------+
94-2031_L4_L7_L8
WSIFKQKAFVDGRVPEELASMGNKIVKMCQGLPLAASVLGGLLHNKEKHEWQAILDGNLLVAGEDDNGENSIKKIL
KLSY            1354
324-2_J1_J3_J8
WSIFKQKAFVDGRVPEELASMGNKIVKMCQGLPLAASVLGGLLHNKEKHEWQAILDGNLLVAGEDDNGENSIKKIL
KLSY            1354
324-2_J2_J5_J6
WSIFKQKAFVDGRVPEELASMGNNIVKMCQGLPLAASALGGLLHNKEKHEWQAILDGNLLVAGEDDNGENSIKKIL
KLSY            1354
487-1_I4_I6_I8
WSIFKQKAFVDGRVPEELASMGNKIVKMCQGLPLAASALGGLLHNKEKHEWQAILDGNLLVAGEDDNGENSIKKIL
KLSY            1354
493-5_F1_F5_F7
WSIFKQKAFVDGRVPEELASMGNNIVKMCQGLPLAASALGGLLHNKEKHEWQAILDGNLLVAGEDDNGENSIKKIL
KLSY            1354
493-7_G2
WSIFKQKAFVDGRVPEELASMGNKIVKMCQGLPLAASVLGGLLHNKEKHEWQAILDGNLLVASEDDNGENSIKKIL
KLSY            1354
493-7_G10
WSIFKQKAFVDGRVPEELASMGNKIVKMCQGLPLAASALGGLLHNKEKHEWQAILDGNLLVAGEDDNGENSIKKIL
KLSY            1354
493-7_G12
WSIFKQKAFVDGRVPEELASMGNNIVKMCQGLPLAASALGGLLHNKEKHEWQAILDGNLLVAGEDDNGENSIKKIL
KLSY            1354
```

FIG. 14I

```
493-7_G14_G22
WSIFKQKAFVDGRVPEELASMGNKIVKMCQGLPLAASVLGGLLHNKEKHEWQAILDGNLLVASEDDNGENSIKKIL
KLSY     1354
493-7_G19
WSIFKQKAFVDGRVPEELASMGNKIVKMCQGLPLAASVLGGLLHNKEKHEWQAILDGNLLVASEDDNGENSIKKIL
KLSY     1354
493-7_G21
WSIFKQKAFVDGRVPEELASMGNTIVKMCQGLPLAASALGGLLHNKEKHEWQAILDGNLLVAGEDDNGENSIKKIL
KLSY     1354
493-9_H5_H30
WSIFKQKAFVDGRVPEELASMGNKIVKMCQGLPLAASALGGLLHNKEKHEWQAILDGNLLVASEDDNGENSLKKIL
KLSY     1354
493-9_H11_H19_H27
WSIFKQKAFVDGRVPEELASMGNNIVKMCQGLPLAASALGGLLHNKEKHEWQAILDGNLLVAGEDDNGENSIKKIL
KLSY     1354
543-5_C2
WSIFKQKAFVDGRVPEELASMGNKIVKMCQGLPLAASVLGGLLHNKEKHEWQAILDGNLLVAGEDDNGENSIKKIL
KLSY     1354
561-2_K4_K14_K22
WSIFKQKAFVDGRVPEELASMGNKIVKMCQGLPLAASVLGGLLHNKEKHEWQAILDGNLLVAGEDDNGENSIKKIL
KLSY     1354
561-2_K6_K30_K31
WSIFKQKAFVDGRVPEELASMGNKIVKMCQGLPLAASVLGGLLHNKEKHEWQAILDGNLLVASEDDNGENSIKKIL
KLSY     1354
849-1_M8_M18_M20
WSIFKQKAFVDGRVPEELASMGNKIVKMCQGLPLAASALGGLLHNKEKHEWQAILDGNLLVAGEDDNGENSIKKIL
KLSY     1354
852-5_E14_E23
WSIFKQKAFVDGRVPEELASMGNKIVKMCQGLPLAASVLGGLLHNKEKHEWQAILDGNLLVAGEDDNGENSIKKIL
KLSY     1357
852-5_E28
WSIFKQKAFVDGRVPEELASMGNKIVKMCQGLPLAASVLGGLLHNKEKHEWQAILDGNLLVAGEDDNGENSIKKIL
KLSY     1354
852-5_E30
WSIFKQKAFVDGRVPEELASMGNKIVKMCQGLPLAASVLGGLLHNKEKHEWQAILDGNLLVAGEDDNGENSIKKIL
KLSY     1357
RH_D3_D4_D7
WSIFKQKAFVDGRVPEELASMGNKIVKMCQGLPLAASALGGLLHNKEKHEWQAILDGNLLVTGEDDNGENSIKKIL
KLSY     1354
Rpi-chc1_ORF
WSIFKQKAFVDGRVPEELASMGNKIVKMCQGLPLAASVLGGLLHNKEKHEWQAILDGNLLVAGEDDNGENSIKKIL
KLSY     1354
chc1_BAC_B07-1C15
WSIFKQRAFVDGKIPEEIVRMEKRIVEMCQGLPLAASVLGGLLRSKEKHEWQAILDGNPLVAGENDNGEKSIKKIL
KLSY     1228
chc2_BAC_B07-1C15
WSIFKQRAFVDGKIPEEIVRMEKRIVENCQGLPLAASVLGGLLLRKEKHEWQAILDGNPLVAGENDNGVKSIKKIL
KLSY     1228
chc_RGC1_BAC_2D06-3D21
WSIFKQRAFVDGKIPEEIVSMEKRIVEMCQGLPLAASVLGGLLRSKGKHEWQAILDGNPLVAGENDNGEKSIKKIL
KLSY     1228
chc_RGC2_BAC_2D06-3D21
WSIFKQRAFVDGKIPEEIVSMEKRIVEMCQGLLLAASVLGGLLRSKEKHEWQAILDGNPLVA--------------
----     1174
RH122B15_c247
WSIFKQRAFVDGEVPEEILSVENKIVEMCQGLPLAASVLGGLFCNKEKHEWQAILDGSSLVASE-D----
SIKNILKLSY    1210
RH122B15_c88-5
WSIFKQKAFVDGRVPEELASMGNKIVEMCQGLPLAASVLGGLLHNKEKHEWQAILDGNPLVAGEDDKGENSIKKIL
TLSY     1174
RH137D14_c13-1
WSIFKQRAFVDGKIPEEIVSMEKRIVEMCQGLPLAASVLGGLLRSKEKHEWQAILDGNPLVAGENDNGEKSIKKIL
KLSY     1423
```

FIG. 14J

RH137D14 c13-2
WSIFKQKAFVDGEVPEELASMGNKIVKMCQGLPLAASALGGLLHNKEKHEWQAILDGNLLVTGEDDNGENSIKKIL
KLSY        1354
RH77O23 c579-4
WSIFEQKAFVDGRVPEELASMGNKIVKMCHGLPLAASVLGGLLHNKEKHEWQAILDGSPLVAGEDDNGENSIKKIL
KLSY        1231
RH77O23 c579-5
WSIFKQRAFVDGEVPEEILSVENKIVEMCQGLPLAASVLGGLFCNKEKHEWQAILDGSSLVASE-D----
SIKNILKLSY        1195
RH77O23 c671
WSIFKQRAFVDGEVPEEILSVENKIVEMCQGLPLAASVLGGLFCNKEKHEWQAILDGSSLVASE-D----
SIKNILKLSY        1210
RH77O23 c706-3
WSIFKQRAFVDGEVPEEMVIMENRIVETCQGLPLAAGVLGGLIRNKEKHEWQAILDSNSLVAHEDDLGENSIKKIL
KLSY        1222
RH77O23 c706-4
WSIFKQKAFVDGRVPEEPASMGNKIVKMCEGLPLAASVLGGLLCNKEKHEWQALLDGNPLIVGEDDNGENNIKKIL
KLSY        1231
ph2 candidate
LSIFKQRAFVDGEVPQEILSMEKKIVELCQGLPLAASVLGCLLCNKEKHEWQAILVAGEDDNGE-N----
SLKKILKLSY           403

Majority
DYLPSPHLKKCFAYFAMFPKDYMFEKDQLIQLWMAEGFLRPSQEIPVMEDVGHRFFQILLQNSLLQDVVLDEHNNI
THCK 490       500       510       520
       530       540       550       560

94-2031_L4_L7_L8
DYLPSPHLKKCFAYFAMFPKDYMFEKDQLIQLWMAEGFLRPSQEIPVMEDVGHRFFQILLQNSLLQDVLLDEHNNI
THCK        1594
324-2_J1_J3_J8
DYLPSPHLKKCFAYFAMFPKDYMFEKDQLIQLWMAEGFLRPSQEIPVMEDVGHRFFQILLQNSLLQDVLLDEHNNI
THCK        1594
324-2_J2_J5_J6
DYLPSPHLKQCFAYFAMFPKDYMFEKDQLIQLWMAEGFLRPSQEIPVMEDVGHRFFQILLQNSLLQDVLDEHNNI
THCK        1594
487-1_I4_I6_I8
DYLPSPHLKKCFAYFAMFPKDYMFEKDQLIQLWMAEGFLRPSQEIPVMEDVGHRFFQILLQNSLLQDVVLDEHNNI
THCK        1594
493-5_F1_F5_F7
DYLPSPHLKQCFAYFAMFPKDYMFEKDQLIQLWMAEGFLRPSQEIPVMEDVGHRFFQILLQNSLLQDVVLDEHNNI
THCK        1594
493-7_G2
DYLPSPHLKQCFAYFAMFPKDYMFEKDQLIQLWMAEGFLRPSQEIPVMEDVGHRFFQILLQNSLLQDVVLDEHNNI
THCK        1594
493-7_G10
DYLPSPHLKKCFAYFAMFPKDYMFEKDQLIQLWMAEGFLRPSQEIPVMEDVGHRPFQILLQNSLLQDVVLDEHNNI
THCK        1594
493-7_G12
DYLPSPHLKQCFAYFAMFPKDYMFEKDQLIQLWMAEGFLRPSQEIPVMEDVGHRFFQILLQNSLLQDVVLDEHNNI
THCK        1594
493-7_G14_G22
DYLPSPHLKKCFAYFAMFPKDYMFEKDQLIQLWMAEGFLRPSQEIPVMEDVGHRFFQILLQDDVLDEHNNI
THCK        1594
493-7_G19
DYLPSPHLKKCFAYFAMFPKDYMFEKDQLTQLWMAEGFLRPSQEIPVMEDVGHRFFQILLQNSLLQDDVLDEHNNI
THCK        1594

FIG. 14K

```
493-7_G21
DYLPSPHLKQCFAYFAMFPKDYMFEKDQLIQLWMAEGFLRPSQEIPVMEDVGHRFFQILLQNSLLQDVVLDEHNNI
THCK        1594
493-8_HS_H30
DYLPSPHLKKCFAYFAMFPKDYMFEKDQLIQLWMAEGFLRPSQEIPVMEDVGHRFFQILLQNCLLQDDVLDEHNNI
THCK        1594
493-9_H11_H19_H27
DYLPSPHLKQCFAYFAMFPKDYMFEKDQLIQLWMAEGFLRPSQEIPVMEDVGHRFFQILLQNSLLQDVVLDEHNNI
THCK        1594
543-5_C2
DYLPSPHLKKCFAYFAMFPKDYMFEKDQLIQLWMAEGFLRPSQEIPVMEDVGHRFFQILLQNSLLQDVLLDEHNNI
THCK        1594
561-2_K4_K14_K22
DYLPSPHLKKCFAYFAMFPKDYMFEKDQLIQLWMAEGFLRPSQEIPVMEDVGHRFFQILLQNSLLQDVLLDEHNNI
THCK        1594
561-2_K6_K30_K31
DYLPSPHLKKCFAYFAMFPKDYMFEKDQLIQLWMAEGFLRPSQEIPVMEDVGHRFFQILLQNSLLQDDVLHEHNNI
THCK        1594
849-1_M8_M18_M20
DYLPSPHLKKCFAYFAMFPKDYMFEKDQLIQLWMAEGFLRPSQEIPVMEDVGHRFFQILLQNSLLQDVVLDEHNYI
THCK        1594
852-5_E14_E23
DYLPSPHLKKCFAYFAMFPKDYMFEKDQLIQLWMAEGFLRPSQEIPVMEDVGHRFFQILLQNSLLQDVLLDEHNNI
THCK        1597
852-5_E28
DYLPSPHLKKCFAYFAMFPKDYMFEKDQLIQLWMAEGFLRPSQEIPVMEDVGHRFFQILLQNSLLQDVLLDEHNNI
THCK        1594
852-5_E30
DYLPSPHLKKCFAYFAMFPKDYMFEKDQLIQLWMAEGFLRPSQEIPVMEDVGHRFFQILLQNSLLQDVVLDEHNNI
THCK        1597
RH_D3_D4_D7
DYLPSPHLKKCFAYFAMFPKDYMFEKDQLIQLWMAEGFLRPSQEIPVMEDVGHRFFQILLQNSLLQDVVLDEHNNI
THCK        1594
Rpi-chc1_ORF
DYLPSPHLKKCFAYFAMFPKDYMFEKDQLIQLWMAEGFLRPSQEIPVMEDVGHRFFQILLQNSLLQDVLLDEHNNI
THCK        1594
chc1_BAC_B07-1C15
DYLPSPQLKKCFAYFAMFPKDFEFEKEQLIQLWMAEGFLHPCQEITVMEDVGHRFFQILLKNSLLQDVELDEHDNI
THCK        1468
chc2_BAC_B07-1C15
DYLPSPQLKKCFAYFALFPKDFEFEKEQLIQLWMAEGFLHPCQEIPVMEDVGHRFFQILLQNSLLQDVELDEHNNI
THCK        1468
chc_RGC1_BAC_2D06-3D21
DYLPSPQLKKCFAYFAMFPKDFEFEKEQLIQLWMAEGFLHPCQETTVMEGIGHRFFQILLQNSLLQDVELDEHNNI
THCK        1468
chc_RGC2_BAC_2D06-3D21  ----------------------
DFEFEKRQLIQLWMAEGFLHPCQEIPAMEDVGHNFFQILLQHSLLQDVELDEQNNITHCK        1354
RH122B15_c247
DYLPSPHLKKCFSYFAMFSKDFKFEKDQLIQLWMAEGFLRPCQETTVMEDVGNKFFQLLLQYSLLQDVNLDEYNNI
THCK        1450
RH122B15_c88-5
VYLPSVQLKKCFAYFAMFPKDSEFEKEQLIQLWMAEGFLHPCQETTVMEDVGHRFFQILLQNSLLQDIKLDELNNI
THCK        1414
RH137D14_c13-1
DYLPSPYLKKCFAYFAMFPKDFEFEKEQLIQLWMAEGFLHPCQETTVMEDVGHRFFQILLKNSLLQDVELDEHNNI
THCK        1663
RH137D14_c13-2
DYLPSPHLKKCFAYFAMFPKDYMFEKDQLIQLWMAEGFLRPSQEIPVMEDVGHRFFQILLQNSLLQDVVLDEHNNI
THCK        1594
RH77023_c579-4
DYLPSPHLKKCFAYFAMLPKDLMFEKAQLIQLWMAEGFLHPCQETTVMEDIGNNFFQLLLRNSLLQDVVLDEHNNI
KYCK        1471
```

FIG. 14L

```
RH77023 c579-5
DYLPSPHLKKCFSYFAMFPKDFKFEKDQLIQLWMAEGFLRPCQETTVMDVGNKFFQLLLQYSLLQDVNLDEYNNI
THCK      1435
RH77023 c671
DYLPSPHLKKCFSYFAIFPKDFEFEKDQLIQLWMAEGFLRPCQETPVMDVGNKFFQLLLQYSLLQDVNLDKYNNT
THCK      1450
RH77023 c706-3
VYLPSPHLKKCFAYFAMFPKDFEFEKDQLIQLWMASGFLHPCQETIVMDVGHKFFQILLQNSLLQDVKLDEHNVI
THGK      1462
RH77023 c706-4
DYLPSPYLKKCFAYFAMFPKDFKFEKDQLIQLWMAEGFLHPCQETTVMEDIGNNFFRLLLRNSLLQDVVLDEHNNI
KYCK      1471
ph2 candidate
DYLPSPHLKKCFAYFAMFPKDFEFEKDQLIQLWMAEGFLRPCQETPVMEDVGIKFFQLLFQYSLLQDVKLDEYNNI
THCK      483

Majority
MHDLVHDLAGDILKSRLFDPKGDNGEKLSQVRYFGCESPTDQIDKIYEPERLCTLFWRSNYTSKDMLLNFKFLRVL
DLSS ----------+---------+---------+---------+---------+----------
-+---------+---------+---------+
                                      570       580       590       600
610       620       630       640
        ----------+---------+---------+---------+
94-2031_L4_L7_L8
MHDLVHDLAGDILKSRLFDPKGNNGEKLSQVRYFGCESPTDQIDKIYEPERLCTLFWRSNYTSKDMLLNFKFLRVL
DLSS        1834
324-2_J1_J3_J8
MHDLVHDLAGDILKSRLFDPKGNNGEKLSQVRYFGCESPTDQIDKIYEPERLCTLFWRSNYTSKDMLLNFKFLRVL
DLSS        1834
324-2_J2_J5_J6
MHDLVHDLAGDILKSRLFDPKGDNGEKLSQVRYFGCESPKDQIDKIYEPERLCTLFWRSNYTSKDMLLNFKFLRVL
DLSS        1834
487-1_I4_I6_I8
MHDLVHDLAGHILKSRLFDPKGDDGEKLSQVRYFGCESPTDQIDKICEPERLCTLFWRSNYTSEDMLLNFKFLRVL
DLSS        1834
493-5_F1_F5_F7
MHDLVHDLAGDILKSRLFDPKGDNGEKLSQVRYFGCESPKDQIDKIYEPERLCTLFWRSNYTSKDMLLNFKFLRVL
DLSS        1834
493-7_G2
MHDLVHDLAGDILKSRLFDPKGDNGEKLSQVRYFGCESPKDQIDKIYEPERLCTLFWRSNYTSKDMLLNFKFLRVL
DLSS        1834
493-7_G10
MHDLVHDLAGDILKSRLFDPKGDDGEKLSQVRYFGCESPTDQIDKIYEPERLCTLFWRSNYTSEDMLLNFKFLRVL
DLSS        1834
493-7_G12
MHDLVHDLAGDILKSRLFDPKGDNGEKLSQVRYFGCESPKDQIDKIYEPERLCTLFWRSNYTSKDMLLNFKFLRVL
DLSS        1834
493-7_G14_G22
MHDLVHDLAGDILKSRLFDPKGDNGEKLSQVRYFGCESPTDQIDKIYEPERLCTLFWRSNYTSKDMLLNFKFLRVL
DLSS        1834
493-7_G19
MHDLVHDLAGDILKSRLFDPKGDNGEKLSQVRYFGCESPTDQIDKIYEPERLCTLFWRSNYTSKDMLLNFKFLRVL
DLSS        1834
493-7_G21
MHDLVHDLAGDILKSRLFDPKGDNGEKLSQVRYFGCESPKDQIDKIYEPERLCTLFWRSNYTSKDMLLNFKFLRVL
DLSS        1834
493-9_H5_H30
MHDLVHDLAGDILKSRLFDPKGDNGEKLSQVRYFGCESPTDQIDKIYEPERLCTLFWRSNYTSKDMLLNFKFLRVL
DLSS        1834
```

FIG. 14M

```
493-9_H11_H19_H27
MHDLVHDLAGDILKSRLFDPKGDNGEKLSQVRYFGCESPKDQIDKIYEPERLCTLFWRSNYTSKDMLLNFKFLRVL
DLSS      1834
543-5_C2
MHDLVHDLAGDILKSRLFDPKGDNGEKLSQVRYFGCESPTDQIDKIYEPERLCTLFWRSNYTSKDMLLNFKFLRVL
DLSS      1834
561-3_K4_K14_K22
MHDLVHDLAGDILKSRLFDPKGNNGEKLSQVRYFGCESPTDQIDKIYEPERLCTLFWRSNYTSKDMLLNFKFLRVL
DLSS      1834
561-2_K6_K30_K31
MHDLVHDLAGDILKSRLFDPKGDNGEKLSQVRYFGCESPADQIDKIYEPERLCTLFWRSNYTSKDMLLNFKFLRVL
DLSS      1834
849-1_M8_M18_M20
MHDLVHDLAGDILKSRLFDPKGDNGEKLSQVRYFGCESPTDQIDKIYEPERLCTLFWRSNYTSKDMLLKYKFLRVL
DLSS      1834
852-5_E14_E23
MHDLVHDLAGDILKSRLFDPKGDNGEKLSQVRYFGCESPTDQIDKIYEPERLCTLFWRSNYTSKDMLLNFKFLRVL
DLSS      1837
852-5_E26
MHDLVHDLAGDILKSRLFDPKGDNGEKLSQVRYFGCESPTDQIDKIYEPERLCTLFWRSNYTSKDMLLNFKFLRVL
DLSS      1834
852-5_E30
MHDLVHDLAGDILKSRLFDPKGDNGEKLSQVRYFGCESPTDQIDKIYEPERLCTLFWRSNYTSKDMLLKYKFLRVL
DLSS      1837
RH_D3_D4_D7
MHDLVHDLAGDILKSRLFDPKGDNGEKLSQVRYFGCESPTDQIDKIYEPERLCTLFWRSNYTSKDMLLKYKFLRVL
DLSS      1834
Rpi-chc1_ORF
MHDLVHDLAGDILKSRLFDPKGDNGEKLSQVRYFGCESPTDQIDKIYEPERLCTLFWRSNYTSKDMLLNFKFLRVL
DLSS      1834
chc1_BAC_B07-1C15
MHDLVHDLAGDILKSKLFDPKGNDGEKLSQVRYFGCESPGDQIDKIYEPKRLCTLFWRNNYISEDMLLSPKLLRVL
DLSS      1708
chc2_BAC_B07-1C15
MHDLVHDLAGEILKCKLFDPKGDDGEKLSQVRYFGCESPMDQIGKIYAPERLCTLFWRDNYIWEDMLLSFKFLRVL
DLSS      1708
chc_RGC1_BAC_2D06-3D21
MHDLVHDLAGDILKSKLFDPKGNDGEKLSQVRYFGCESPMDQIDKIYEPERLCTLFWRNNYIWEDMLLSFKFLRVL
DLSS      1708
chc_RGC2_BAC_2D06-3D21     MHDLVHDLAGDILKSKLFDPKGDDGENLSQVRYFG--------------
----------------------------  1459
RH122B15 c247
MHDLVHDLAHDIFKSKLFEQKSVGGENLSQVRYFGWESPSDQIDKIYEPGRLCTLFWKSN-
ISDDMLLSPQFLRVLNLSG      1687
RH122B15 c88-5
VHDLVHDLAGDILKSKLFDPKGDDGEKLSQVRYFGCESPRNQIDKIYEPQRLCTLFWRSNSISEDMLLSFKFLRAL
NLSS      1654
RH137D14 c13-1
MHDLVHDLAGDILKSKLFDPKGNDGEKPSQVRYFGCESPGDQIDKIYEPERLCTLFWRNNYIWEDMLLSFKLLRVL
DLSS      1903
RH137D14 c13-2
MHDLVHDLAGDILKSRLFDPKGDNGEKLSQVRYFGCESPTDQIDKIYEPERLCTLFWRSNYTSKDMLLKYKFLRVL
DLSS      1834
RH77O23 c579-4
MHDLVHDLAGDIFKSKIFDSKGNDGEKLSQVRYFGWDSPSDQIDKINEPGRLCTLFWRNNYISEDMLLSPKFLRVL
NLSR      1711
RH77O23 c579-5
MHDLVHDLAGDIFKSKLFDQKSVGGENLSQVRYFGWESPSDQIDKIYEPGRLCTLFWKSN-
ISDDMLLSPQFLRVLNLSG      1672
RH77O23 c671
MHDLVHDLAGDIFKSKLFDQKSVGGESLSQVRYFGWESPSDQIDKIYEPGRLCTLFWRSNHISEAMLLSFKFLRVL
NLSS      1690
```

FIG. 14N

```
RH77023 c706-3
MHDLVHDLAGDILKSKLFDPKGDVGEISSQVRYFGSDSPIDQIDKINEPGRLCALFSRSN-
IPNDVLFSFQFLRVLNLSR      1699
RH77023 c706-4
MHDLVHDLAGDILKSKLFDRKGNDGEKLSQVRYCGWDSPSDQIGKINEPGRLCTLFWRSNYISEDMLLSFKFLRVL
NLSS      1711
ph2 candidate
MHDLVHDLAGDILKSKLFDKKSVEGENLSQVRYFGWDSPSDQIDKISEPGRLCTLFWESN-
ISDDMLLSFQFLRVLNLSA      562

Majority      SGIKELSAKIGKLIYLRYLDLS------------
NTEITALPNSICKLYNLQTFRVI-NCFSLQELPYEMRNMISLRHIY
+----------+----------+----------+----------+
                                     650       660       670       680
690       700       710       720
                            ----------+----------+----------+----------
+----------+
94-2031_L4_L7_L8          SGIKELSAKIGKLIYLRYLDLS------------
NTEITALPNSICKLYNLQTFRVI-NCFSLQELPYEMRNMISLRHIY      2035
324-2_J1_J3_J8            SGIKELSAKIGKLIYLRYLDLS------------
NTEITALPNSICKLYNLQTFRVI-NCFSLQELPYEMRNMISLRHIY      2035
324-2_J2_J5_J6            SGIKELSAKIGKLIYLRYLDLS------------
NTEITALPNSICKLYNLQTFRVI-NCFSLQGLPYEMRNMISLRHIY      2035
487-3_I4_I6_I8            SGIKELSAKIGKLIYLRYLDLS------------
NTEITALPNSICELYNLQTFRVI-NCFSLQKLPYEMGNMVSLRHIY      2035
493-5_F1_F5_F7            SGIKELSAKIGKLIYLRYLDLS------------
NTEITALPNSICELYNLQTFRVI-NCFSLQGLPYEMRNMISLRHIY      2035
493-7_G2                  SGIKELSAKIGKLIYLRYLDLS------------
NTEITALPNSICELYNLQTFRVI-NCFSLQGLPYEMRNMISLRHIY      2035
493-7_G10                 SGIKELSAKIGKLIYLRYLDLS------------
NTEITALPNSICELYNLQTFRVI-NCFSLQKLPYEMGNMVSLRHIY      2035
493-7_G12                 SGIKELSAKIGKLIYLRYLDLS------------
NTEITALPNSICELYNLQTFRVI-NCFSLQGLPYEMRNMISLRHIY      2035
493-7_G14_G22             SGIKELSAKIGKLIYLRYLDLS------------
NTEITALPNSICELYNLQTFRVI-NCFSLQELPYEMRNMISLRHIY      2035
493-7_G19                 SGIKELSAKIGKLIYLRYLDLS------------
NTEITALPNSICKLYNLQTFRVI-NCFSLQELPYEMRNMISLRHIY      2035
493-7_G21                 SGIKELSAKIGKLIYLRYLDLS------------
NTEITALPNSICKLYNLQTFRVI-NCFSLQELPYEMRNMISLRHIY      2035
493-9_H5_H30              SGIKELSAKIGKLIYLRYLDLS------------
NTEITALPNSICKLYNLQTFRVI-NCFSLQELPYEMRNMISLRHIY      2035
493-9_H11_H19_H27         SGIKELSAKIGKLIYLRYLDLS------------
NTEITALPNSICELYNLQTFRVI-NCFSLQGLPYEMRNMISLRHIY      2035
543-5_C2                  SGIKELSAKIGKLIYLRYLDLS------------
NTEITALPNSICKLYNLQTFRVI-NCFSLQELPYEMRNMISLRHIY      2035
561-2_K4_K14_K22          SGIKELSAKIGKLIYLRYLDLS------------
NTEITALPNSICKLYNLQTFRVI-NCFSLQELPYEMRNMISLRHIY      2035
561-2_K6_K30_K31          SGIKELSAKIGKLIYLRYLDLS------------
NTEITALPNSICKLYNLQTFRVI-NCFSLQELPYEMRNMISLRHIY      2035
849-1_M6_M18_M20          SGIKELSTKIGKLIYLRYLDLS------------
NTEITALPNSICELYNLQTFRVI-NCFSLQELPYEMRNMISLRHIY      2035
852-5_E14_E23             SGIKELSAKIGKLIYLRYLDLS------------
NTEITALPNSICKLYNLQTFRVI-NCFSLQELPYEMRNMISLRHIY      2038
852-5_E28                 SGIKELSAKIGKLIYLRYLDLS------------
NTEITALPNSICKLYNLQTFRVI-NCFSLQELPYEMRNMISLRHIY      2035
852-5_E30                 SGIKELSTKIGKLIYLRYLDLS------------
NTEITALPNSICELYNLQTFRVI-NCFSLQELPYEMRNMISLRHIY      2038
RH_D3_D4_D7               SGIKELSTKIGKLIYLRYLDLS------------
NTEITALPNSICELYNLQTFRVI-NCFSLQELPYEMRNMISLRHIY      2035
Rpi-chcl_ORF              SGIKELSAKIGKLIYLRYLDLS------------
NTEITALPNSICKLYNLQTFRVI-NCFSLQELPYEMRNMISLRHIY      2035
```

FIG. 14O

```
chc1_BAC_B07-1C15         SGINELSTKIGNLIYLRYLDLS-------------
NTEITALPSSICELYNLQTFRVI-NCFSLQELPYEMRNMISLRHIY      1909
chc2_BAC_B07-1C15         SGINEVSAKIGKLIYLRYLDLS-------------
NTNITALPNSICELYSLQTFRVI-NCFSLKELPYEMGNMISLRHIY      1909
chc_RGC1_BAC_2D06-3D21    SGIKELSAKIGMLIYLRYLDLS-------------
NTKITALPNSICKLYNLQTFRVI-NCHSLKELPYEMGNMISLRHIY      1909
chc_RGC2_BAC_2D06-3D21    -------------------------------F--
LPNSICELYNLQTFRVN-DCFSLRELPYEMGNMISLRHIY     1579
RH122B15 c247
SDIKELSASIVKLIYLRYLDLSNTKMNDRYLDLSNTKMNDLPNSICKLYNLQTLRFY-
CWYPLRKLPEEMANMISLRHIC      1924
RH122B15 c88-5            SGIKELSAKIGKLIYLRYLDLS-------------
NTKITALPNSICKLYNLQTFRVI-NCHSLKELPYEMGNMISLRHIY      1855
RH137D14 c13-1            SGINELSAKIGNLIYLRYLDLS-------------
NTEITALPNSICELYNLQTFRVI-NCFSLQELPYEMRNMRSLRHIY      2104
RH137D14 c13-2            SGIKELSTKIGKLIYLRYLDLS-------------
NTEITALPNSICELYNLQTFRVI-NCFSLQELPYEMRNMISLRHIY      2035
RH77023 c579-4            SGIKELSASIGKLIYLRYLDIS-------------
STEITALPHSICKLYNLQTFRAN-CCYSLKEFPYEMGNMISLRHIY      1912
RH77023 c579-5
SDIKELSASIVKLIYLRYLDLSNTKMNDGYLDLSNTEMNDLPNSICKLYNLQTLRFYSSWYPLRKLPEEMANMISL
RHIC      1912
RH77023 c671              SGIKELPAKIGKLIYLRYLDLS-------------
NTKITALPNSICKLYNLQTLRFYSIWYPLGKLPEEMANMISLRHIC      1894
RH77023 c706-3            SGIKELSASIGKLVHLRYLDLS-------------
YSGIKALPNSICKLYSMQTLRVS-KCFLLKELPDEMANMISLRHVY      1900
RH77023 c706-4            SGIFGLSDKIGKLIYLRYLDIS-------------
STEITALPHSICKLYNLQTFRVN-YCYSLKEFPYEMGNMISLRHIY      1912
ph2 candidate             SGIKELSAKISKLIFLRYLDIS-------------
DTRIEDFPDSICKLYNLQTFRVN-DCSSLRKLPEEMANMISLRHIY      629

Majority
YTSVDETSGHWGGWCLHNEHFQIPLNMGQLTSLQTLKFPKVGLEKGRQIEELGHLKNLRGELTINGLQLVCDKEEA
RTAY ---------+---------+---------+---------+-------
                                          730       740       750       760
---------+---------+---------+---------+
770       780       790       800
---------+---------+---------+
94-2031_L4_L7_L8
YTSVDETSGHWGGWCLHNEHFQIPLNMGQLTSLQTLKFPKVGLEKGRQIEELGHLKNLRGELTINGLQLVCDKEEA
QTAY        2275
324-2_J1_J3_J8
YTSVDETSGHWGGWCLHNEHFQIPLNMGQLTSLQTLKFPKVGLEKGRQIEELGHLKNLXGELTINGLQLVCDKEEA
XTAY        2275
324-2_J2_J5_J6
YTSIDETSGHWGGWCLHNEHFQIPLNMGQLTSLQTLKFPKVGLEKGRQIEELGHLKNLGGELTINGLQLVCDKEEA
RTAY        2275
487-1_I4_I6_I8
YTSVDKRNEHWGGWCILNERFQMSLKMRQLTCLQTLKFFKIGLKKGRQIEELGHLKNLRGELTINGLQLVCDKEEA
RTAY        2275
493-5_F1_F5_F7
YTSIDETSGHWGGWCLHNEHFQIPLNMGQLTSLQTLKFPKVGLEKGRQIEELGHLKNLGGELTINGLQLVCDKEEA
RTAY        2275
493-7_G2
YTSIDETSGHWGGWCLHNEHFQIPLNMGQLTSLQTLKFPKVGLEKGRQIEELGHLKNLGGELTINGLQLVCDKEEA
RTAY        2275
493-7_G10
YTSVDKRNEHWGGWCILNERFQMPLKMRQLTCLQTLKFFKIGLKKGRQIEELGHLKNLRGELTINGLQLVCDKEEA
RTAY        2275
```

FIG. 14P

```
493-7_G12
YTSIDETSGHWGGWCLHNEHFQIPLNMGQLTSLQTLKFFKVGLEKGRQIEELGHLKNLGGELTINGLQLVCDKEEA
RTAY        2275
493-7_G14_G22
YTSVDETSGHWGGWCLHNEHFQIPLNMGQLTSLQTLKFFKVGLEKGRQIEELGHLKNLRGELTINGLQLVCDKEEA
QTAY        2275
493-7_G19
YTSVDETSGHWGGWCLHNEHFQIPLNMGQLTSLQTLKFFKVGLEKGRQIEELGHLKNLRGELTINGLQLVCDKEEA
QTAY        2275
493-7_G21
YTSVDETSGHWGGWCLHNEHFQIPLNMGQLTSLQTLKFFKVGLEKGRQIEELGHLKNLRGELTINGLQLVCDKEEA
QTAY        2275
493-9_H5_H30
YTSVDETSGHWGGWCLHNEHFQIPLNMGQLTSLQTLKFFKVGLEKGRQIEELGHLKNLRGELTINGLQLVCDKEEA
QTAY        2275
493-9_H11_H19_H27
YTSIDETSGHWGGWCLHNEHFQIPLNMGQLTSLQTLKFFKVGLEKGRQIEELGHLKNLGGELTINGLQLVCDKEEA
RTAY        2275
543-5_C2
YTSIDETSGHWGGWCLHNEHFQIPLNMGQLTSLQTLKFFKVGLEKGRQIEELGHLKNLGGELTINGLQLVCDKEEA
RTAY        2275
561-2_K4_K14_K22
YTSVDETSGHWGGWCLHNEHFQIPLNMGQLTSLQTLKFFKVGLEKGRQIEELGHLKNLRGELTINGLQLVCDKEEA
QTAY        2275
561-2_K6_K30_K31
YTSVDETSGHWGGWCLHNEHFQIPLNMGQLTSLQTLKFFKVGLEKGRQIEELGHLKNLRGELTINGLQLVCDKEEA
QTAY        2275
849-1_M8_M18_M20
YTSVDKRTLHWGGWCLHNEHFQIPLNMGQLTSLQTLKFFKVGLEKGRQIEELGHLKNLRGELTINGLQLVCDKEEA
RTAY        2275
852-5_E14_E23
YTSVDETSGHWGGWCLHNEHFQIPLNMGQLTSLQTLKFFKVGLEKGRQIEELGHLKNLRGELTINGLQLVCDKEEA
QTAY        2278
852-5_E28
YTSVDETSGHWGGWCLHNEHFQIPLNMGQLTSLQTLKFFKVGLEKGRQIEELGHLKNLRGELTINGLQLVCDKEEA
QTAY        2275
852-5_E30
YTSVDETSGHWGGWCLHNEHFQIPLNMGQLTSLQTLKFFKVGLEKGRQIEELGHLKNLRGELTINGLQLVCDKEEA
.TAY        2278
RH_D3_D4_D7
YTSVDETSGHWGGWCLHNEHFQIPLNMGQLTSLQTLKFFKVGLEKGRQIEELGHLKNLRGELTINGLQLVCDKEEA
RTAY        2275
Rpi-chc1_ORF
YTSVDETSGHWGGWCLHNEHFQIPLNMGQLTSLQTLKFFKVGLEKGRQIEELGHLKNLRGELTINGLQLVCDKEEA
QTAY        2375
chc1_BAC_B07-1C15
YTFVDETSGHWGSWCIRNEHFQMPLNMGQLTSLQTLQFFKVGLQKGRQIEELGHLKNLRGELRINGLQLVCDKEEA
RTAY        2149
chc2_BAC_B07-1C15
YSSINKRNRHWGGWCIRNEHFQMPLNMGQLTCLQTLQFFKVGLEKGHQIEELGHLKNLRGKLRINGLQFVCDKEEA
RTAY        2149
chc_RGC1_BAC_2D06-3D21
YTSVDKGNQHWGGWCILNEHFQMPLNMGQLTSLQTLQFFKVGLEKGRQIEELGHLKNLRGELRINGLQLVCDKEEA
RTTY        2149
chc_RGC2_BAC_2D06-3D21
FTSVDKRTLHWGAWCIHYNNFQMPLNMGQLTSLQTLQFFKVGLEKGRQIEELGHLKNLRGELRFKGLQLVCDKEEA
RTAY        1819
RH122B15_c247        CYQFFE-SD-----------
FQMPLNMGQLTSLQTLPFFYVGSEKGRRIEELGCLKNLRGELTIERLQLVGNKEEARTAY        2128
RH122B15_c88-5
YTSADETNGHLGEWCIRNERFQMPLNMRQLTCLQTLQFFKVGVAKGRQIEELGHLKNLRGELTINGLQLVGDREEA
RTAN        2095
```

FIG. 14Q

```
RH137D14 c13-1
YTFVDETSGHWGEWCIRNEHFQMPLNMGQLTSLQTLQFFKVGLEKGRQIEELGHLKNLRGELRINGLQLVCDKEEA
RTAY       2344
RH137D14 c13-2
YTSVDETSGHWGGWCLHNEHPQIPLNMGQLTSLQTLKFFKVGLEKGRQIEELGHLKNLRGELTINGLQLVCDKEEA
RTAY       2275
RH77O23 c579-4              FYSSSQ----------------
MPLNLGQLTCLQTLQYFNVGLEKGHRIEELGCLNNLRGELSINELELVRSREDALTAY       2104
RH77O23 c579-5              CYHFFE-SD-------------
FQMPLNMGQLTSLQTLPFFYVGSEKGRRIEELGCLKNLRGELTIERLQLVGNKEEARTAY       2116
RH77O23 c671                CYHFFE-SD-------------
SQMPLNMGQLTSLQTLQFFYVGLKKGRRIEELGCLKNLRGELTIKRLQLVGNKEEARTAY       2098
RH77O23 c706-3              YNS-----------
LCMDNKHFQMPFNMGKLTCLQTLQFFKVGSEKGRRIEEIGHLKNLRGELTIEGLQLVCNREEARTAY
2110
RH77O23 c706-4              FYSSSQ----------------
MPLNLGQLTCLQTLQYFNVGLEKGRRIEELGRLKNLRGKLRINGLQLVRDREEARTAC       2104
ph2 candidate               CN---G-SD-------------
MQTPLNMGQLTSLQTLRVFYIGSEKGRRIKELGRLKNLRGKLTINHLQLVRNKEEAQTAN       694

Majority
LHDKPNICKLAYLWSHDESEGCEINDEHVLDGLQPHPNLKTLAVVDYLGTKFPSWFSEESLPNLVKLKLSGSKRCK
EIPS ----------+---------+---------+---------+---------+---------+
                                    810       820       830       840
         850       860       870       880
          ----------+---------+---------+---------+---------+---------+
94-2031_L4_L7_L8
LHDKPNICKLAYLWSHDESEGCEINDEHVLDGLQPHPNLKTLAVVDYLGTKFPSWFSEESLPNLVELKLSGSKRCK
EIPS       2515
324-2_J1_J3_J8
LHDKPNICKLAYLWSHDESEGCEINDEHVLDGLQPHPNLKTLAVVDYLGTKFPSWFSEESLPNLVELKLSGSKRCK
EIPS       2515
324-2_J2_J5_J6
LHDKPNICKLAYLWSHDESEGCVINDEHVLDGLQPHPNLKTLAVVDYLGTKFPSWFSEESLPNLVKLKLSGSKRCK
EIPS       2515
487-1_I4_I6_I8
LHDKPNICKLAFLWSHDESEGSEINDEHVLDGLQPHPNLKTLAVVDYLGTKFPSWFHEESLPNLVKLKLSGSKRCK
EIPS       2515
493-S_F1_F5_F7
LHDKPNICKLAYLWSHDESEGCVINDEHVLDGLQPHPNLKTLAVVDYLGTKFPSWFSEESLPNLVKLKLSGSKRCK
EIPS       2515
493-7_G2
LHDKPNICKLAYLWSHDESEGCVINDEHVLDGLQPHPNLKTLAVVDYLGTKFPSWFSEESLPNLVKLKLSGSKRCK
EIPS       2515
493-7_G10
LHDKPNIFKLAFLWSHDESEGCEINDEHVLDGLQPHPNLKTLAVVDYLGTKFPSWFSEESLPNLVKLKLSGSKRCK
EIPS       2515
493-7_G12
LHDKPNICKLAYLWSHDESEGCVINDEHVLDGLQPHPNLKTLAVVDYLGTKFPSWFSEESLPNLVKLKLSGSKRCK
EIPS       2515
493-7_G14_G22
LHDKPNICKLAYLWSHDESEGCEINDEHVLDGLQPHPNLKTLAVVDYLGTKFPSWFSEESLPNLVKLKLSGSKRCK
EIPS       2515
493-7_G19
LHDKPNICKLAYLWSHDESEGCEINDEHVLDGLQPHPNLKTLAVVDYLGTKFPSWFSEESLPNLVKLKLSGSKRCK
EIPS       2515
493-7_G21
LHDKPNICKLAYLWSHDESEGCEINDEHVLDGLQPHPNLKTLAVVDYLGTKFPSWFSEESLPNLVKLKLSGSKRCK
EIPS       2515
```

FIG. 14R

```
493-9_H5_H30
LHDKPNICKLAYLWSHDESEGCEINDEHVLDGLQPHPNLKTLAVVDYLGTKFPSWFSEESLPNLVKLKLSGSKRCK
EIPS        2515
493-9_H11_H19_H27
LHDKPNICKLAYLWSHDESEGCVINDEHVLDGLQPHPNLKTLAVVDYLRTKFPSWFSEESLPNLVKLKLSGSKRCK
EIPS        2515
543-5_C2
LHDKPNICKLAYLWSHDESEGCEINDEHVLDGLQPHPNLKTLAVVDYLGTKFPSWFSEESLPNLVKLKLSGSKRCK
EIPS        2515
561-2_K4_K14_K22
LHDKPNICKLAYLWSHDESEGCEINDEHVLDGLQPHPNLKTLAVVDYLGTKFPSWFSEESLPNLVELKLSGSKRCK
EIPS        2515
561-2_K6_K30_K31
LHDKPNICKLAYLWSHDESEGCEINDEHVLDGLQPHPNLKTLAVVDYLGTKFPSWFSEESLPNLVKLKLSGSKRCK
EIPS        2515
849-1_M8_M18_M20
LHDKPNICKLAYLWSHDESEGCEINDEHVLDGLQPHPNLKTLAVVDYLGTKFPSWFREESLPNLVKLKLSGSKRCK
EIPS        2515
852-5_E14_E23
LHDKPNICKLAYLWSHDESEGCEINDEHVLDGLQPHPNLKTLAVVDYLGTKFPSWFSEESLPNLVKLKLSGSKRCK
EIPS        2518
852-5_E28
LHDKPNICKLAYLWSHDESEGCEINDEHVLDGLQPHPNLKTLAVVDYLGTKFPSWFSEESLPNLVKLKLSGSKRCK
EIPS        2515
852-5_E30
LHDKPNICKLAYLWSHDESEGCEINDEHVLDGLQPHPNLKTIAVVDYLGTKFPSWFREESLPNLVKLKLSGSKRCK
EIPS        2518
RH_D3_D4_D7
LHDKPNICKLAYLWSHDESEGCEINDEHVLDGLQPHPNLKTIAVVDYLGTKFPSWFREESLPNLVKLKLSGSKRCK
EIPS        2515
Rpi-chc1_ORF
LHDKPNICKLAYLWSHDESEGCEINDEHVLDGLQPHPNLKTLAVVDYLGTKFPSWFSEESLPNLVKLKLSGSKRCK
EIPS        2515
chc1_BAC_B07-1C15
LQEKPNICKLAYLWSHDESEGCEINDEHVLDGLQPHPNLKTLEVNNYLGTKFPSWFSEELIPNLVKLILSGCKRCK
EIPS        2389
chc2_BAC_B07-1C15
LQEKPNICELVYLWSHVESEGCEINDEHVLDGLQPHPNLKTLAVGNYLGTKFPSWFSEESLPNLVKLKLIGCKRCK
EIPS        2389
chc_RGC1_BAC_2D06-3D21
LQEKPNICKLAYLWSHDDSEGREINDEPVLDGLQPHPNLKTLSVVNYLGTKFPSWFSEVSLPNLVKLKLSGSKRCK
EIPS        2389
chc_RGC2_BAC_2D06-3D21
LQEKPNICKLAYLWSHDELEGCEINDEHVLDGLQPHPNLKSLAVVGFLGTKFPSWFIEESLPNLVKLKLSGCKRCK
EIPS        2059
RH122B15_c247
LQEKPNIYKLVYSWSHDEPEGCEINHEHVLDGLQPHPNLKTLEVVDYLGTKFASWFSEKMLPNLVMLRLSGCKRCK
EIPS        2368
RH122B15_c88-5
LQEKSNIYKLAFVWSHDEEEGSETNDEYVLDGLQPHPNLKTLAVVGYLGTKFPSWFREDLLPNLVKLKLSGCKRCK
EIPS        2335
RH137D14_c13-1
LQEKPNICKLAYLWSHDESEGCEINDEHVLDGLQPHPNLKTLEVWNYLGTKFPSWFSEELIPNLVKLILSGCKRCK
EIPS        2584
RH137D14_c13-2
LHDKPNICKLAYLWSHDESEGCEINDEHVLDGLQPHPNLKTIAVVDYLGTKFPSWFREESLPNLVKLKLSGSKRCK
EIPS        2515
RH77023_c579-4
LQEKSNIYKLTYLWSHQESEGCEINAEHVLDGLQPHPYLKTPEVVRYLGTRFPSWFNEESLPNLVKLKLSNCSSCK
EIPS        2344
RH77023_c579-5
LQEKPNIYKLVYSWSHDEPEGCEINHEHVLDGLQPHPNLKTLEVVDYLGTKFASWFSEKMLSNLVMLRLSGCKRCK
EIPS        2356
```

FIG. 14S

```
RH77023 c671
LQEKPNIYKLVYSWSHDESEGCEINHEHVLDGLQPHPNLKTLEVVDYLGTKFASWFSEKMLPNLVMLRLRGCKRCK
EIPS      2338
RH77023 c706-3
LQEKPKIYKLKYVWSHDEPEGCETSDEYVLDGLQPHPNLKTLAVVEYMGTRFPSWFSEEFLPNLVRLKLSGCKRCK
GIPS      2350
RH77023 c706-4
LREKLNIYKLAYLWSHEESEGCEINDEHVLDGLQPHPNLKTFEVKNYLGTRFPSWFSEESLPNLVKLKLSGCKRCK
EIPS      2344
ph2 candidate
LQEKPNIYKLVYSWSHDESEGCEINDEHVLDGLQPHPNLKALSVVDYLGTKLPSWFSEELLPNLVKLKLSGCKRCT
EIPS      774

Majority    LGQLKFLRHLELIGPHELECIGPAFYGVEIRNIGSNSI---
IQVFPSLKELVLEDMRSLIEWKGDE------VG-----V +---------+---------+---------+---------+---------
                                     890       900       910       920
  930       940       950       960
             ---------+---------+---------+---------+---------+---------
+---------+---------+---------+
94-2031_L4_L7_L8           LGQLKFLRHLELVGPHELECIGPAFYGVEMRNIGSNSI---
IQVFPSLKKLVLKDMRSLIEWKGDE------VG-----V          2713
324-2_J1_J3_J8             LGQLKFLRHLELVGPHELECIGPAFYGVEMRNIGSNSI---
IQVFPSLKELVLKDMRSLIEWKGDE------VG-----V          2713
324-2_J2_J5_J6             LGQLKFLRHLELIGPHELECIGPALYGVEIRNTGSNSN---
IQVFPSLKELVLEDMRSLIEWKGDE------VG-----V          2713
487-1_I4_I6_I8             LGQLKFLRHLELIGPHELECIGPAFYGVEIRNIGSNNI---
IQVFPSLKELVLEDMRSLIEWKGDE------VG-----V          2713
493-5_F1_F5_F7             LGQLKFLRHLELIGPHELECIGPALYGVEIRNTGSNSN---
IQVFPSLKELVLEDMRSLIEWKGDE------VG-----V          2713
493-7_G2                   LGQLKFLRHLELIGPHELECIGPALYGVEIRNTGSNSN---
IQVFPSLKELVLEDMRSLIEWKGDE------VG-----V          2713
493-7_G10                  LGQLKFLRHLELIGPHELECIGPALYGVEIRNTGSNSN---
IQVFPSLKELVLEDMRSLIEWKGDE------VG-----V          2713
493-7_G12                  LGQLKFLRHLELIGPHELECIGPALYGVEIRNTGSNSN---
IQVFPSLKELVLEDMRSLIEWKGDE------VG-----V          2713
493-7_G14_G22              LGQLKFLRHLELIGPHELECIGPAFYGVEIRNIGSNSI---
IQVFPSLKKLVLTDMRSLIEWKGDE------VG-----V          2713
493-7_G19                  LGQLKFLRHLELIGPHELECIGPALYGVEIRNTGSNSN---
IQVFPSLKELVLEDMRSLIEWKGDE------VG-----V          2713
493-7_G21                  LGQLKFLRHLELIGPHELECIGPAFYGVEIRNIGSNSI---
IQVFPSLKKLVLTDMRSLIEWKGDE------VG-----V          2713
493-9_H6_H30               LGQLKFLRHLELIGPHELECIGPAFYGVEMRNIGSNSI---
IQVFPSLKKLVLKDMRSLIEWKGDE------VG-----V          2713
493-9_H11_H19_H27          LGQLKFLRHLELIGPHELECIGPALYGVEIRNTGSNSN---
IQVFPSLKELVLEDMRSLIEWKGDE------VG-----V          2713
543-5_C2                   LGQLKFLRHLELIGPHELECIGPALYGVEIRNTGSNSN---
IQVFPSLKELVLEDMRSLIEWKGDE------VG-----V          2713
561-2_K4_K14_K22           LGQLKFLRHLELVGPHELECIGPAFYGVEIRNIGSNSI---
IQVFPSLKKLVLKDMRSLIEWKGDE------VG-----V          2713
561-2_K6_K30_K31           LGQLKFLRHLELIGPHELECIGPAFYGVEIRNIGSNSI---
IQVFPSLKKLVLTDMRSLIEWKGDE------VG-----V          2713
849-1_M8_M18_M20           LGQLKFLRHLELIGPHELECIGPAFYGVEIRNIGSNSI---
IQVFPSLKELVLEDMRSLIEWKGDE------VG-----V          2713
852-5_E14_E23              LGQLKFLRHLELIGPHELECIGPAFYGVEMRNIGSNSI---
IQVFPSLKKLVLKDMRSLIEWKGDE------VG-----V          2716
852-5_E28                  LGQLKFLRHLELIGPHELECIGPAFYGVEMRNIGSNSI---
IQVFPSLKELVLKDMRSLIEWKGDE------VG-----V          2713
852-5_E30                  LGQLKFLRHLELIGPHELECIGPAFYGVEIRNIGSNSI---
IQVFPSLKELVLEDMRSLIEWKGDE------VG-----V          2716
```

FIG. 14T

```
RH_D3_D4_D7            LGQLKFLRHLELIGFHELECIGPAFYGVEIRNIGSNSI---
IQVFPSLKELVLEDMRSLIEWKGDE------VG-----V      2713
Rpi-chc1_ORF           LGQLKFLRHLELIGFHELECIGPAFYGVEMRNIGSNSI---
IQVFPSLKKLVLEDMRSLIEWKGDE------VG-----V      2713
chc1_BAC_B07-1C15      LGQLKFLRHLELVGFHELECIGPALYGVEISNIGSSSI---
IQVFPSLKELVLEDMSSLIEWKGAE------VG-----V      2587
chc2_BAC_B07-1C15      LGQLKFLRHLELVGFHELECIGPALYGVEISNIGSNSI---
VQVFPSLKELVLEDMRSLIEWKGDE------VG-----V      2587
chc_RGC1_BAC_2D06-3D21 LGQLKFLRHLELIGFHELECIGPALYGVEVSNIGSNSI---
IQVFPSLKELVLEDMRSLIEWKGDE------VG-----V      2587
chc_RGC2_BAC_2D06-3D21 LGQLKFLRHLELVGFHELECIGPALYGVEISNIGSSSI---
IQVFPSLKELVLEDMHSLIEWKGDE------VG-----V      2257
RH122B15 c247          LGQLKSLRHLQLIGFLELECIGPTFYGVDVNNNGSSSN---
IQVFPSLKELELNNMSSLIEWKGDE------VG-----V      2866
RH122B15 c88-5         LGQLKLLRHLELSKLHKVECIGPKFYG---KNIGSNSN---
IQVFPSLKELVLKSMSSLIEWKGDE------VG-----V      2524
RH137D14 c13-1         LGQLKFLRHLELVGFHELECIGPALYGVEISNIGSSSI---
IQVFPSLKELVLKDMSSLIEWKGAE------VG-----V      2782
RH137D14 c13-2         LGQLKFLRHLELIGFHELECIGPAFYGVEIRNIGSNSI---
IQVFPSLKELVLEDMRSLIEWKGDE------VG-----V      2713
RH77023 c579-4
LGQLKFLQHLELVGFHKLECIGTTFYGIEVNNMGSSSNNAIIQVFLSLKELVLENMRSLIEWKGVE------
LIPTTSGV      2566
RH77023 c579-5         LGQLKSLRHLQLIGFLELECIGPTFYGVDVNNNGSSSN---
IQVFPSLKELELNNMSSLIEWKGDE------VG-----V      2554
RH77023 c671           LGQLKSLRHLELIGFLELECIGPTFYGVDVNNNGSSSN---
IQVFPSLKELELNNMSSLIEWKGDE------VG-----V      2536
RH77023 c706-3         LGQLKFLQHLELVGFHKVEYIEPTFYGNDNGSSRNNTN---
IQVFPLLKELLLEDMPSLTEWKEVQLLPKGNVGRDRLGV      2581
RH77023 c706-4
LGQLKFLRHLELVGFHKVECIGTIFYGIEVNNKGSSSNNGNIQVFPLLKELVLEDMHSLIEWKGVE------
LIPTN-GV      2563
ph2 candidate          LGQLKFLRHLELVGFHELKCIGPALYGVEISNIGSSSI---
IQVFPSLKELVLEDMRSLIEWKGDE------VG-----V      840

Majority
RMSPGLEKLRITDCPLLKSIPNQFEILRELEIRGVDSEMPLLNLCSNLTSLVKLSVYDMKELTCLPDEMLRNNVSL
QQIT ----------+---------+---------+---------+---------
+---------+---------+---------+
                              970        980       990       1000
1010     1020      1030      1040
                                 ---------+---------+---------+---------+---------
+---------+---------+
94-2031_L4_L7_L8
RMSPGLEKLRITDCPLLKSIPNQFEILRQLKITGVDSEMPLLNLCSNLTSLVKLRVYDMKELTCLPDEMLRNNVSL
QQII      2953
324-2_J1_J3_J8
RMSPGLEKLRITDCPLLKSIPNQFEILRQLKITGVDSEMPLLNLCSNLTSLVKLRVYDMKELTCLPDEMLRNNVSL
QQII      2953
324-2_J2_J5_J6
RMSPGLEKLRITDCPLLKSIPNQFEILCELEIRGVDSEMPLLNLCSNLTSLVKLSVYDMNELTCLPDEILRNNVSL
QQIT      2953
487-1_I4_I6_I8
RMSPGLEKLRITDCPLLKSIPNQFEILRELEIRGVDSEMPLLNLCSNLTSLVNLSVYDMKELTCLPDEILRMNISL
QQIT      2953
493-5_F1_F5_F7
RMSPGLEKLRITDCPLLKSIPNQFEILCELEIRGVDSEMPLLNLCSNLTSLVKLSVYDMNELTCLPDEILRNNVSL
QQIT      2953
493-7_G2
RMSPGLEKLRITDCPLLKSIPNQFEILCELEIRGVDSEMPLLNLCSNLTSLVKLSVYDMNELTCLPDEILRNNVSL
QQIT      2953
```

FIG. 14U

```
493-7_G10
RMFPRLEKLRIMECPLLKSTPSQFESLRELDIVTVDSEMPLLNLCSNLTSLVELSVFAVKELTCLPDEMLRNNVSL
QQIT       2953
493-7_G12
RMSPGLEKLRITDCPLLKSIPNQFEILCELEIRGVDSEMPLLNLCSNLTSLVKLSVYDMNELTCLPDEILRNNVSL
QQIT       2953
493-7_G14_G22
RMSPGLEKLRITDCPLLKSIPNQFEILRQLDIRGVDSEIPLWNLCSNLTSLVKLSVYDMKELTCLPDEMLRNNVSL
QQIM       2953
493-7_G19
RMSTGLEKLRITDCPLLKSIPNQFEILCELEIRGVDSEMPLLNLCSNLTSLVKLSVYDMNELTCLPDEILRNNVSL
QQIT       2953
493-7_G21
RMSPGLEKLRITDCPLLKSIPNQFEILRQLDIRGVDSEIPLLNLCSNLTSLVKLSVYDMKELTCLPDEMLRNNVSL
QQIM       2953
493-9_H5_H30
RMSPGLEKLRIIDCPLLKSIPNQFEILRQLDIRGVDSEMPLLNLCSNLTSLVKLSVYDMKELTCLPDEMLRNNVSL
QQII       2953
493-9_H11_H19_H27
RMSPGLEKLRITDCPLLKSIPNQFEILCELEIRGVDSEMPLLNLCSNLTSLVKLSVYDMNELTCLPDEILRNNVSL
QQIT       2953
543-5_C2
RMSPGLEKLRITDCPLLKSIPNQFEILRELEIRGVDSEMPLLNLCSNLTSLVKLSVYDMNELTCLPDEILRNNVSL
QQIT       2953
561-2_K4_K14_K22
RMSPGLEKLRITDCPLLKSIPNQFEILRQLKITGVDSEMPLLNLCSNLTSLVKLRVYDMKELTCLPDEMLRNNVSL
QQII       2953
561-2_K6_K30_K31
RMSPGLEKLRITDCPLLKSIPNQFEILRQLDIRGVDSEIPLLNLCSNLTSLVKLSVYDMKELTCLPDEMLRNNVSL
QQIM       2953
849-1_M8_M18_M20
RMSPGLEKLRITDCPLLKSIPNQFEILRELEIRGVDSEMPLLNLCSNLTSLVNLSVYDMKELTCLPDEILCNNISL
QQIT       2953
852-5_E14_E23
RMSPGLEKLRITDCPLLKSIPNQFEILRQLKITGVDSEMPLLNLCSNLTSLVKLRVYDMKELTCLPDEMLRNNVSL
QQII       2956
852-5_E28
RMSPGLEKLRITDCPLLKSIPNQFEILRQLKITGVDSEMPLLNLCSNLTSLVKLRVYDMKELTCLPDEMLRNNVSL
QQII       2953
852-5_E30
RMSPGLEKLRITDCPLLKSIPNQFEILRELEIRGVDSEMPLLNLCSNLTSLVNLSVYDMKELTCLPDEILRNNISL
QQIT       2956
RH_D3_D4_D7
RMSPGLEKLRITDCPLLKSIPNQFEILRELEIRGVDSEMPLLNLCSNLTSLVNLSVYDMKELTCLPDEILRNNISL
QQIT       2953
Rpi-chc1_ORF
RMSPGLEKLRITDCPLLKSIPNQFEILRQLKITGVDSEMPLLNLCSNLTSLVKLRVYDMKELTCLPDEMLRNNVSL
QQII       2953
chc1_BAC_B07-1C15
RMSPGLEKLRITDCPLLKSIPNQFEILRELRIEGVDSEMPLLNLCSNLTSLVHLSVSNVKELTCLPDEMLRSNVSL
QHLS       2827
chc2_BAC_B07-1C15
RMSPGLEKLRITDCPLLKSIPNQFEILRDLEIRGVDSEMPLLNLCSNLTSLVSLDVCNVKELTFLPDEMLRNNVSL
QHLS       2827
chc_RGC1_BAC_2D06-3D21
RMSAGLEKLRITDCPLLKSIPNQFEILRDLEITGVDSEMPLLNLCSNLTSLVYLEVCKVKELTCLPDEMLRNNVSL
QQIL       2827
chc_RGC2_BAC_2D06-3D21
RMSPGLEKLRITDCPLLKSIPNQFEILRELEITGVDSEMPLFNLCSNLTSLVNLSVCNVKKLTCLPDEMLRNNVSL
QYLS       2497
RH122B15_c247
RMFPRLEKLTISNCPLLKSTPNQFEILSELVIARVDSEMPLLNLCINLPSLVELGVYDIKELTCLPDEMLRNNVSL
QRLM       2806
```

FIG. 14V

```
RH122B15 c88-5
RMFPRLEKLTITECPLLKSTPSQFEILRELEIVIVDSEMPLLNLCSNLTSLVELRVSDMKELTCLPDEILRNNVSL
QHLS      2764
RH137D14 c13-1
RMSPGLEKLRITNCPLLKSIPNQFEILRELSIEGVDSEMPLLNLCSNLTSLVFLAVSTVKELTCLPDEMLRSNVSL
QRLS      3022
RH137D14 c13-2
RMSPGLEKLRITDCPLLKSIPNQFEILRELEIRGVDSEMPLLNLCSNLTSLVNLSVYDMKELTCLPDEILRNNISL
QQIT      2953
RH77O23 c579-4
KMFPVLEKLRIRYCPLLKSTPKQLEILRELSIERVDSEMPLLNLCSNLTSLVKFSVSFVKELTCFPDEMLRSNVSL
QHLS      2806
RH77O23 c579-5
RMFPRLEKLTISNCPLLKSTPNQFEILRELEIVMVDSEMPLLNLCSNLTSLVGLSVHDIKELTCFPDEMLRNKVSL
QNLV      2794
RH77O23 c671
RMFPRLEKLTIRNCPLLKSTPNQFEILSELVIVRVDSEMPLLNLCSNLPSLVELEVDDMKELTCLPDEMLRNNVSL
QHIS      2776
RH77O23 c706-3
RMFPVLKKLTIRNCPLLKSTPNQFEILRELSIEGVDSEIPLLNLCSNLTSLVMLIIRDVKQLTCLTDEILRNNFSL
QHLL      2831
RH77O23 c706-4
RMFPQLEKLKISNCPLLKSIPNQFEILRELEIRVVDSEMPLLNLFNNLTSLLELRVYDVKELTCLPDEMLRNNLSL
QHLS      2803
ph2 candidate
RMFLRLEKLRISNCPLLKSTPSQFEILHELIIEGVDSEMPLLNLCSNLISLVKLDVDNVKELTCLSDVMLRNNVSL
QYIS      920

Majority
        IPNCGEFRELPQSLYNLHSLKRLDIYNCTNFSSLPVPNGDNYLTSLQFFFLYNCNGLISIPIGMLDQCRSLEFLHV
        SCCN
                    ---------+---------+---------+---------+----------
        +---------+---------+---------+
                                      1050      1060      1070      1080
        1090      1100      1110      1120
                    *********+*********+*********+*********+**********
        +*********+*********+*********+
94-2031_L4_L7_L8
IFNCGEFRELPQSLYNLHSLRRLDIYNCTNFSSLPVPNGGNYLTSLEFFCLYNCNGLISIPIGMLDQCR-
LVFLNVSCCN        3190
324-2_J1_J3_J8
IFNCGEFRELPQSLYNLHSLRRLDIYNCTNFSSLPVPNGGNYLTSLEFFCLYNCNGLISIPIGMLDQCR-
LVFLNVSCCN        3190
324-2_J2_J5_J6
IFNCGEFRELPQSLYNLHSLKRLDIYNCTNFSSLPVPNGDNYLTSLEFFFLYNCNGLISIPIGMLDQCRSLEFLHV
SCCN      3193
487-1_I4_I6_I8
IFNCGEFRELPQSLYNLHSLYRLDIYNCTNFSSLPVPKGDNYLTSLIFFFLHNCNGLISIPIGMLDQCRSLEYLHV
SCCN      3193
493-5_F1_F5_F7
IFNCGEFRELPQSLYNLHSLKRLDIYNCTNFSSLPVPNGDNYLTSLEFFFLYNCNGLISIPIGMLDQCRSLEFLHV
SCCN      3193
493-7_G2
IFNCGEFRELPQSLYNLHSLKRLDIYNCTNFSSLPVPNGDNYLTSLEFFFLYNCNGLISIPIGMLDQCRSLEFLHV
SCCN      3193
493-7_G10
IFNCGEFRELPQSLYNLHSLKRLGIYNCTNFSSLPVPNGDNYLTSLQLFFLYNCNGLISIPIGMLDQCRSLEFLNV
SCCN      3193
493-7_G12
IFNCGEFRELPQSLYNLHSLKRLDIYNCTNFSSLPVPNGDNYLTSLEFFFLYNCNGLISIPIGMLDQCRSLEFLHV
SCCN      3193
```

FIG. 14W

```
493-7_G14_G22
IFDCGEFRELPQSLYNLHFLKRLEIYNCTNFSSLPVPNGDNYLTSLQFFQLYNCDGLISLPIGMLDQCRSLECLSV
SCCN        3193
493-7_G19
IFNCGEFRELPQSLYNLHSLKRLDIYNCTNFSSLPVPNGDNYLTSLEFFFLYNCNGLISIPIGMLDQCRSLEFLHV
SCCN        3193
493-7_G21
IFDCGEFRELPQSLYNLHFLKRLEIYNCTNFSSLPVPNGDNYLTSLQFFQLYNCDGLISLPIGMLDQCRSLECLSV
SCCN        3193
493-9_H5_H30
IFNCGEFRELPQSLYNLHSLRRLDIFNCTNFSSLPVPNGDNYLTSLEFFYLYNCNGLISIPIGMLDQCR-
LVFLNVSCCN        3190
493-9_H11_H19_H27
IFNCGEFRELPQSLYNLHSLKRLDIYNCTNFSSLPVPNGDNYLTSLEFFFLYNCNGLISIPIGMLDQCRSLEFLHV
SCCN        3193
543-5_C2
IFNCGEFRELPQSLYNLHSLKRLDIYNCTNFSSLPVPNGDNYLTSLEFFYLYNCNGLISIPIGMLDQCRSLEFLHV
SCCN        3193
561-2_K4_K14_K22
IFNCGEFRELPQSLYNLHSLRRLDIYNCTNFSSLPVPNGGNYLTSLEFFCLYNCNGLISIPIGMLDQCR-
LVFLNVSCCN        3190
561-2_K6_K30_K31
IFDCGEFRELPQSLYNLHFLKRLEIYNCTNFSSLPVPNGDNYLTSLQFFQLYNCDGLISLPIGMLDQCRSLECLSV
SCCN        3193
849-1_M8_M18_M20
IFECGEFRELPQSLYNLHSLYRLDIYNCTNFSSLPVPKGDNYLTSLIFFFLHNCNGLISIPIGMLDQCRSLEYLHV
SCCN        3193
852-5_E14_E23
IFNCGEFRELPQSLYNLHSLRRLDIYNCTNFSSLPVPNGDNYLTSLEFFCLHNCNGLISIPVGMLDQCR-
LVFLNVSCCN        3193
852-5_E28
IFNCGEFRELPQSLYNLHSLRRLDIYNCTNFSSLPVPNGDNYLTSLEFFCLHNCNGLISIPVGMLDQCR-
LVFLNVSCCN        3190
852-5_E30
IFECGEFRELPQSLYNLHSLYRLDIYNCTNFSSLPVPKGDNYLTSLIFFFLHNCNGLISIPIGMLDQCRSLEYLHV
SCCN        3196
RH_D3_D4_D7
IFECGEFRELPQSLYNLHSLYRLDIYNCTNFSSLPVPKGDNYLTSLIFFFLHNCNGLISIPIGMLDQCRSLEYLHV
SCCN        3193
Rpi-chc1_ORF
IFNCGEFRELPQSLYNLHSLRRLDIYNCTNFSSLPVPNGDNYLTSLEFFCLHNCNGLISIPIGMLDQCR-
LVFLNVSCCN        3190
chc1_BAC_B07-1C15
VFECGEFRELPQSLYNLHSLKRLVIACCTNFSSLPVPSGDKNLTSLQLLQLMNCDGLISLPIGMLDQCRSLKFLSV
RGCN        3067
chc2_BAC_B07-1C15
VFHCGEFRELPQSLYNLHSLKILVIHNCTSFSSLPVPKGDNYLTSLQLFQLYNCDGLISLPIGMLDQCRSLDFFSV
RCCN        3067
chc_RGC1_BAC_2D06-3D21
IFGCGKFRELPQSLYNLHSLRILEIICCTNFSSLPVPCGDNYLTSLQIFQLTDCDGLISLPIGMLDQCRSLELLNV
ICCD        3067
chc_RGC2_BAC_2D06-3D21
VTDCEEFRELPQSLYNLHSLKRLRIHSCTNFSSLPVPNGDNYLTSLQLLMLCNDGLISLPIGMLDQCRSLEILSV
SCCD        2737
RH122B15 c247                    VSGCGEFRELPQSVYNLHSLKRLTIERCTNFSSFPVPSEENYLTSLQDLR.
3959
RH122B15 c68-5
VFDCEEFRELPQSLYNLHSLKTLRISNCANFSSFPVPSGENYLTSLQSLQLFDCDGLTSLPSGVLEHCRSLESLVV
IYCN        3004
RH137D14 c13-1
VFNCGEFRELPQSLYNLHSLERLVIAGCTNFSSLPVPSGDNNLPSLKLLQLMNCDGLISLPIGMLDQCRSLKVLTV
RCCN        3262
```

FIG. 14X

```
RH137D14 c13-2
IFECGEFRELPQSLYNLHSLYRLDIYNCTNFSSLPVPKGDNYLTSLIFFFLHNCNGLISIPIGMLDQCRSLEYLHV
SCCN        3193
RH77023 c579-4
VYNCREFRELPQSLYNLHSLKSLMIEYCTNFSSPPVPSGENYLTSLQNLQLWSCGGLASLPSGMLEKCRSLQNLRV
NYCN        3046
RH77023 c579-5
VSGCGEFHELPQSLYNLHSLKTLKITRCANFNSFPVPSGENYLTSLQHLQLRDCEGLSSLPSGMLEHCRSLETLSV
SCCD        3034
RH77023 c671
VSDCREFHELPQSLYNLHSLKRLTIDNCTNFSSFPVPSEENYLTSLQELRLLDCDGLSSLPSGMLEHCRSLBTLSV
SCCD        3016
RH77023 c706-3
VLNCGEFRELPQSLYNLRSLKSLSIGDCTNFSSIPVSRGENHLTSLLKLRLYNCDGLTSLSSGLLEHCRSLESLNV
NKCN        3061
RH77023 c706-4
VSYCGEFRELPQSLYNLHSLKSLRIDNCTNFNFFPVPKGENYLTSLQSLELCYCDGLTSLPSGLLEHCRSLESLKV
HNCN        3043
ph2 candidate
VVDCGEFREFPQSLYNLHSLESLRIQHCPNFSSFIVPCGENYLTSLQNFELQGCNGLTSLPSGMLEQCRSLKNLSV
SWCD        1000

Majority
NLVSFPLHVWEMPSLSYLDISECPKLISVPKVGLHHLTGLLRLGIGPFSEMVDFDAFQLIFNGIQQLLSLRDLEVY
GRGH ----------+---------+---------+---------+---------+
+---------+---------+---------+
                                  1130      1140      1150      1160
   1170      1180      1190      1200
                                 ---------+---------+---------+---------+
+---------+---------+---------+
94-2031_L4_L7_L8
NLVSFPVHVWEMPSLSYLVISECPKLISVPKVGLHHLTGLVRLGIGPFSEMVDFDAFQLIFNGIQQLLSLRDLEVY
GRGH        3430
324-2_J1_J3_J8
NLVSFPVHVWEMPSLSYLVISECPKLISVPKVGLHHLTGLVRLGIGPFSEMVDFDAFQLIFNGIQQLLSLRDLEVY
GRGH        3430
324-2_J2_J5_J6
NLVSFPLHVWEMPSFSFLDIRECPKLISVPKVGLHHLTGLLSLGIGPFSEMVDFDAFQLIFNGIQQLLSLRDLEVY
GRGH        3433
487-1_I4_I6_I8
NLVSFPLHVWEIPSFSVLEITECPKLISVPEVGLHHLTGLLRLGIGPFSEMVDFDAFQLIFNGIQKLLSLRDLEVY
GRGH        3433
493-5_F1_F5_F7
NLVSFPLHVWEMPSFSFLDIRECPKLISVPKVGLHHLTGLLSLGIGPFSEMVDFDAFQLIFNGIQQLLSLRDLEVY
GRGH        3433
493-7_G2
NLVSFPLHVWEMPSFSFLDIRECPKLISVPKVGLHHLTGLLSLGIGPFSEMVDFDAFQLIFNGIQQLLSLRDLEVY
GRGH        3433
493-7_G10
NLVSFPLRVWEMPSLLFLDITECPKLISVPKVGLHHLTGLLRLGIGPFSKMVDFDAFQLIFNGIQQLLSLRDLEVY
GRGH        3433
493-7_G12
NLVSFPLHVWEMPSFSFLDIRECPKLISVPKVGLHHLTGLLSLGIGPFSEMVDFDAFQLIFNGIQQLLSLRDLEVY
GRGH        3433
493-7_G14_G22
NLVSFPLHVWEMPSLSYLVISECPKLISVPEVGLHRLTGLLRLGIGPFSEMVDFDAFQLIFNGIQQLLSLSDLEVY
GRGH        3433
493-7_G19
NLVSFPLHVWEMPSFSFLDIRECPKLISVPKVGLHHLTGLLSLGIGPFSEMVDFDAFQLIFNGIQQLLSLRDLEVY
GRGH        3433
```

FIG. 14Y 493-7_G21
NLVSFPLHVWEMPSLSYLVISECPKLISVPEVGLHRLTGLLRLGIGPFSEMVDFDAFQLIFNGIQQLLSLSDLEVY
GHGH        3433
493-9_H5_H30
NLVSFPLHVWEMPSFSVLNIKECPKLISVPKVGLHHLTGLVRLGIGPFSEMVDFDAFQLIFNGIQQLS-
LRDLEVYGRGH    3427
493-9_H11_H19_H27
NLVSFPLHVWEMPSFSFLDIRECPKLISVPKVGLHHLTGLLSLGIGPFSEMVDFDAFQLIFNGIQQLLSLRDLEVY
GRGH        3433
543-5_C2
NLVSFPLHVWEMPSFSFLDIRECPKLISVPKVGLHHLTGLLSLAIGPFSEMVDFDAFQLIFNGIQQLLSLRDLAVY
GRGH        3433
561-2_K4_K14_K22
NLVSFPVHVWEMPSLSYLVISECPKLISVPKVGLHHLTGLVRLGIGPFSEMVDFDAFQLIFNGIQQLLSLRDLEVY
GRGH        3430
561-2_K6_K30_K31
NLVSFPLHVWEMPSLSYLVISECPKLISVPEVGLHRLTGLLRLGIGPFSEMVDFDAFQLIFNGIQQLLSLSDLEVY
GHGH        3433
849-1_M8_M18_M20
NLVSFPLHVWEIPSFSVLEITECPKLISVPEVGLHHLTGLLRLGIGPFSEMVDFDAFQLIFNGIQKLLSLRDLEVY
GRGH        3433
852-5_E14_E23
NLVSFPVHVWEMPSLSYLVISECPKLISVPKVGLHHLTGLVRLGIGPFSEMVDFDAFQLIFNGIQQLLSLRDLEVY
GRGH        3433
852-5_E28
NLVSFPVHVWEMPSLSYLVISECPKLISVPKVGLHHLTGLVRLGIGPFSEMVDFDAFQLIFNGIQQLLSLRDLEVY
GRGH        3430
852-5_E30
NLVSFPLHVWDIPSFSVLEITECPKLISVPEVGLHHLTGLLRLGIGPFSEMVDFDAFQLIFNGIQKLLSLRDLEVY
GRGH        3436
RH_D3_D4_D7
NLVSFPLHVWEIPSFSVLEITECPKLISVPEVGLHHLTGLLRLGIGPFSEMVDFDAFQLIFNGIQKLLSLRDLEVY
GRGH        3433
Rpi-chc1_ORF
NLVSFPVHVWEMPSLSYLLISECPKLISVPKVGLHHLTGLVRLGIGPFSEMVDFDAFQLIFNGIQQLLSLRDLEVY
GRGH        3430
chc1_BAC_B07-1C15
NLVSFPLHVWEMHSLLHLCISLCPKLISVPEVGLHRLTGLWGLEIGPFSEMVDFDAFQLIFNGIQQLLSLRALTVY
GHGH        3307
chc2_BAC_B07-1C15
NFVSFPLHVWEMPSLSYFDISQCPKLISVPEVGLHRLTGLWYLGIGPFSEMVDFDAFQLIFNGIQQLLSLRDLAVY
GRGH        3307
chc_RGC1_BAC_2D06-3D21
NLVSLPLHVWEMPSLSRLNISQCPKLISVPEVGLHRFAGLQTLKIGPFSEML----------------LS-
LCDLAVYGRGH    3262
chc_RGC2_BAC_2D06-3D21
NLVSFPLHVWEMPSLLYLEISRCPKLISVPEVGLHRLTGLWKLEIGPFSEMVDFDAFQLIFNGIQQLLSLRDLEVY
GRGH        2977
RH122B15 c247
2959
RH122B15 c88-5
NLLSLPLHVWEMPSLSYLGLSGCPKLISVPSGGLHRLTGLRALEIGPFSEMVDFEAFQLIFNGIQQLLSLHNVGVT
GRGH        3244
RH137D14 c13-1
NLVSFPLHVWEMHSLLHLCISLCPKLISVPKVGLHRLTGLWGLEIGPFSEMVDFDAFQLIFNGIQQLLSLRDLTVY
GHGH        3502
RH137D14 c13-2
NLVSFPLHVWEIPSFSVLEITECPKLISVPEVGLHHLTGLLRLGIGPFSEMVDFDAFQLIFNGIQKLLSLRDLEVY
GRGH        3433
RH77O23 c579-4
NLVSFPLHVGDMPSLSYLSIAHCPKLDSVPTGGLHHLTRLRELEIGPVSDMVDFEAFQLTFNGIQQLLSLRTLLVF
GHLH        3266

FIG. 14Z

```
RH77023 c579-5
NLVSFPLHVGEMPSLSYLNISRCPKLISLPSGGIDHLTELSELKIGPFSEMVDFEAFQLIFNGIQQLLSLRTLTVY
GHGH       3274
RH77023 c671
NLVSFPLHVGEMPSLSYLYISQCPKLISLPSGGIHHLTELSELEIGPFSEMVDFEAFQLIFNGIQQLLSLRTLWVY
GHGH       3256
RH77023 c706-3
NLVSLPLHVWGMPSLSYLNISKCPKLESVPAGSLHRLTGLRTLHTGPFSELVDFEAFQLIFNGIQQLSSLCVLWVY
GHAH       3301
RH77023 c706-4
NLVSFPLHVCGMPSLSYLGLSQCPKLISVPSGGLHHLTRLRESHIGPFSEMVDFEAFQLMFNGIHQLSSLRTLEVW
GHLH       3283
ph2 candidate
NLVSFPLHECEMPSLSWLDISQCPKLISVSTGCLHRLTGLIVLGIGPFSEKVDFEVFQLIFSGVQQLFSLRSLWVY
GHLH       1080

Majority
WDSLPYQLMQLSDLREITIADFGIEALPPRLDNLTSLESLTLVRCKRLQHLNFSDAMPKLRLLWISDCPLLEALSD
GLGN ----------+----------+----------+----------+----------
+----------+----------+----------+
                                  1210       1220       1230       1240
1250       1260       1270       1280
                       ----------+----------+----------+----------+----------
+----------+----------+----------+
94-2031_L4_L7_L8
WDSLPYQLMQLSDLREITIADFGIEALPPTLDNLTSLESLTLVRCKQLQHLNFSDAMPKLRLLWIRDCPLLEALSD
GLGN       3670
324-2_J1_J3_J8
WDSLPYQLMQLSDLREITIADFGIEALPPTLDNLTSLESLTLVRCKQLQHLNFSDAMPKLRLLWIRDCPLLEALSD
GLGN       3670
324-2_J2_J5_J6
WDSLPYQLMQLSNLREITIADFGIEALPPRLDNLTSLESLTLDRCKRLQHLNFSDAMPKLRLLWISDCPLVEALSD
GLGN       3673
487-1_I4_I6_I8
WDSLPYQLMQLSNLRKITIADFGIEALPPRLDNLTSLESLTLERCKRLQHLNFSDAMPKLRLLWISDCPLLEALSD
GLGN       3673
493-5_F1_F5_F7
WDSLPYQLMQLSNLREITIADFGIEALPPRLDNLTSLESLTLDRCKRLQHLNFSDAMPKLRLLWISDCPLVEALSD
GLGN       3673
493-7_G2
WDSLPYQLMQLSNLREITIADFGIEALPPRLDNLTSLESLTLDRCKRLQHLNFSDAMPKLRLLWISDCPLVEALSD
GLGN       3673
493-7_G10
WDSLPYQIMQLSDLREITIADFGIEALPPRLDNLTSLESLTLVRCKQLQHLNFSDAMPKLRLLWIRDFPLLEALSD
GLGN       3673
493-7_G12
WDSLPYQLMQLSNLREITIADFGIEALPPRLDNLTSLESLTLDRCKRLQHLNFSDAMPKLRLLWISDCPLVEALSD
GLGN       3673
493-7_G14_G22
WDSLPYQLMQLSDLREIQIADFGIEALPPRLDNLTSLESLTLVRCKRLQHLNFSDAMPSLRLLWIRDCPLLEALSD
DLGN       3673
493-7_G19
WDSLPYQLMQLSNLREITIADFGIEALPPRLDNLTSLESLTLDRCKRLQHLNFSDAMPKLRLLWISDCPLVEALSD
GLGN       3673
493-7_G21
WDSLPYQLMQLSDLREIQIADFGIEALPPRLDNLTSLESLTLVRCKRLQHLNFSDAMPSLRLLWIRDCPLLEALSD
DLGN       3673
493-9_H5_H30
WDSLPYQLMQLSDLREITIADFGIEALPPTLDNLTSLESLTLVRCKQLQHLNFSDAMPKLRLLWIRDCPLLEALSD
GLGN       3667
```

FIG. 14AA

```
493-9_H11_H19_H27
WDSLPYQLMQLSNLREITIADFGIEALPPRLDNLTSLESLTLDRCKRLQHLNFSDAMPKLRLLWISDCPLVEALSD
GLGN          3673
543-5_C2
WDSLPYQLMQLSNLREITIADFGIEALPPRLDNLTSLESLTLERCKRLQHLNFSDAMPKLRLLWISDCPLVEALSD
GLGN          3673
561-2_K4_K14_K22
WDSLPYQLMQLSDLREITIADFGIEALPPTLDNLTSLESLTLVRCKQLQHLNFSDAMPKLRLLWIRDCPLLEALSD
GLGN          3670
561-2_K6_K30_K31
WDSLPYQLMQLSDLREIQIADFGIEALPPRLDNLTSLESLTLVRCKRLQHLNFSDAMPSLRLLWIRDCPLLEALSD
DLGN          3673
849-1_M8_M18_M20
WDSLPYQIMQLSNLRKITIADFGIEALPPRLDNLTSLESLTLERCKRLQHLNFSDAMPKLRHLWISDCPLLEALSD
GLGN          3673
852-5_E14_E23
WDSLPYQLMQLSDLREITIADFGIEALPPTLDNLTSLESLTLVRCKQLQHLNFSDAMPKLRLLWIRDCPLLEALSD
GLGN          3673
852-5_E28
WDSLPYQLMQLSDLREITIADFGIEALPPTLDNLTSLESLTLVRCKQLQHLNFSDAMPKLRLLWIRDCPLLEALSD
GLGN          3670
852-5_E30
WDSLPYQLMQLSNLRKITIADFGIEALPPRLDNLTSLESLTLERCKRLQHLNFSDAMPKLRHLWISDCPLLEALSD
GLGN          3676
RH_D3_D4_D7
WDSLPYQLMQLSNLRKITIADFGIEALPPRLDNLTSLESLTLERCKRLQHLNFSDAMPKLRHLWISDCPLLEALSD
GLGS          3673
Rpi-chc1_ORF
WDSLPYQLMQLSDLREITIADFGIEALPPTLDNLTSLESLTLVRCKQLQHLNFSDAMPKLRLLWIRDCPLLEALSD
GLGN          3670
chc1_BAC_B07-1C15
WDSLPYQLMQLSDLREIVIGDFGIEALPPSLDNLTSLESLMLSGCKRLQHLNFSDAMPKLRHLWIHGCPLLEALSD
GLGN          3547
chc2_BAC_B07-1C15
WDSLPYQIMQLSDLREITIADFGIEALPPRLVNLTSLESLTLVRCKRLQHLNFSDAMPKLRLLWIGDCPLLEALSD
GIGN          3547
chc_RGC1_BAC_2D06-3D21
WDSLPYQIMQLSDLREITIADFGIEALPPRLDNLTSLERLSLAGCKWLQHLNFSDAMPKLRLLWISDCPLLEALSD
GLGN          3502
chc_RGC2_BAC_2D06-3D21
WDSLPYQLMQLSDLIAIKIADFGIEALPPRLDNLTSLERLTLKGCKWLQQLNFSNVMPKLWLLWINDCPLLEALSD
GLGN          3217
RH122B15 c247
2959
RH122B15 c88-5
WDSLPYQLMQLSSLTHIHICDFGIEALPHRFSNLTSLESLMLARCQQLQRVDFSDVMPKLRYLEIHNCPLLEALSD
GLGN          3484
RH137D14 c13-1
WDSLPYQLMQLSDLREITIADFGIEALPPRLDNLTSLESLVLSGCKRLQHLNFSDAMPKLRHLWIHDCPLLEALSD
GLGN          3742
RH137D14 c13-2
WDSLPYQLMQLSNLRKITIADFGIEALPPRLDNLTSLESLTLERCKRLQHLNFSDAMPKLRHLWISDCPLLEALSD
GLGS          3673
RH77O23 c579-4
WDSLPYQLMQLSALTHIHICDFGIEALPHRLDNLTSLEILHLVRCKWLQHVDFSDAMPKLRYLRICDCPLLEALSD
APCN          3526
RH77O23 c579-5
WDSLPYQFMQLSGLTAIHICGPGIEALPHRFGNLTSLETLMLLRCKRLQNLDFSYVMPKLQYLFVYESPLLEALSD
GLGN          3514
RH77O23 c671           WDSLPYQFMQLSGLTS-----------ESRLFLIDLATLLLLER,
3358
RH77O23 c706-3         WDSLPYQLLEFSSVTEIGITDFGIKAPP--------
IETLELVSCKQLQHL-----------LINDCPYLEALSDGLSN          3481
```

FIG. 14AB

```
RH77023 c706-4
WDSLPYQLMQLSALKEIRIYGFGIEALPHRFGNLTSLERLHLVGCNRLQHVDFSDDMPKLQLLWIQDCLLLEDLSN
GLGN        3923
pb2 candidate
WDSLPYQIMQLSALKNLSIDDFGIEALPHRFDNLTSLETISLKRCKRLRHVDFSDAITKLRNLWIQDCFLLEALSD
GLGN        1160

Majority    LVSLEELYLQDCEKLEHLPSRDAMRRLTKLWNMGIKG-
CPKLEESFTNYS----QWSKISHISNIELGGWR------RTA 1290      1300      1310      1320
        1330      1340      1350      1360

94-2031_L4_L7_L8            LVSLEELYLHDCEKLEHLPSRDAMRRLTKLWNMRIKG-
CPKLEESFTNYS----QWSKISHISNIELGGWR------RTA       3877
324-2_J1_J3_J8              LVSLEELYLHDCEKLEHLPSRDAMRRLTKLWNMRIKG-
CPKLEESFTNYS----QWSKISHISNIELGGWR------RTA       3877
324-2_J2_J5_J6              LVSLEELYLQDCEKLELLPSRDAMRRLTKLWNMGIKG-
CPKLEESFTNYS----QWSKISHISNIELGGWR------RTA       3880
487-1_I4_I6_I8              IVSLEELYLQDCEKLEHLPSRDAMRRLTKLWNMRIKG-
CPKLEESFINYS----QWSKISHISNIELGGWR------RTA       3880
493-5_F1_F5_F7              LVSLEELYLQDCEKLELLPSRDAMRRLTKLWNMGIKG-
CPKLEESFTNYS----QWSKISHISNIELGGWR------RTA       3880
493-7_G2                    LVSLEELYLQDCEKLELLPSRDAMRRLTKLWNMGIKG-
CPKLEESFTNYS----QWSKISHISNIELGGWR------RTA       3880
493-7_G10                   LVSLEELYLHDCEKLEHLPSRDAMRCLTKLWNMGIKG-
CPKLEESYTNYS----QWSKISHISNIELGGRR------STA       3880
493-7_G12                   LVSLEELYLQDCEKLELLPSRDAMRRLTKLWNMGIKG-
CPKLEESFTNYS----QWSKISHISNIELGGWR------RTA       3880
493-7_G14_G22               LVSLEELYLLDCKKLEGLPSRDAMRRLTKLWNLGIKG-CPKLKET-----
-----WSKISHIPRIEFGGMII-----KDT       3865
493-7_G19                   LVSLEELYLQDCEKLELLPSRDAMRRLTKLWNMGIKG-
CPKLEESFTNYS----QWSKISHISNIELGGWR------RTA       3880
493-7_G21                   LVSLEELYLLDCKKLEGLPSRDAMRRLTKLWNLGIKG-CPKLKET-----
-----WSKISHIPRIEFGGMII-----KDT       3865
493-9_H5_H30                LVSLEELYLHDCEKLEHLPSRDAMRRLTKLWNMGIKG-
CPKLEESFINYS----QWSKISHISVIELGGWR------RTT       3874
493-9_H11_H19_H27           LVSLEELYLQDCEKLELLPSRDAMRRLTKLWNMGIKG-
CPKLEESFTNYS----QWSKISHISNIELGGWR------RTA       3880
543-5_C2                    LVSLEELYLQDCEKLELLPSRDAMRRLTKLWNMGIKG-
CPKLEESFTNYS----QWSKISHISNIELGGWR------RTA       3880
561-2_K4_K14_K22            LVSLEELYLHDCEKLEHLPSRDAMRRLTKLWNMRIKG-
CPKLEESFTNYS----QWSKISHISNIELGGWR------RTA       3877
561-2_K6_K30_K31            LVSLEELYLLDCKKLEGLPSRDAMRRLTKLWNLGIKG-CPKLKET-----
-----WSKISHIPRIEFGGMII-----KDT       3865
849-1_M8_M18_M20            IVSLEELYLQDCEKLEHLPSRDAMRRLTKLWNMRIKG-
CPKLEESFTNYS----QWSKISHISNIELGGWR------RTT       3880
852-5_E14_E23               LVSLEELYLHDCEKLEHLPSRDAMRRLTKLWNMRIKG-
CPKLEESFTNYS----QWSKISHISNIELGGWR------RTA       3880
852-5_E28                   LVSLEELYLHDCEKLEHLPSRDAMRRLTKLWNMRIKG-
CPKLEESFTNYS----QWSKISHISNIELGGWR------RTA       3877
852-5_E30                   IVSLEELYLQDCEKLEHLPSRDAMRRLTKLWNMRIKG-
CPKLEESFTNYS----QWSKISHISNIELGGWR------RTT       3883
RH_D3_D4_D7                 IVSLEELYLQDCEKLEHLPSRDAMRRLTKLWNMRIKG-
CPKLEESFTNYS----QWSKISHISNIELGGWR------RTT       3880
Rpi-chc1_ORF                LVSLEELYLHDCEKLEHLPSRDAMRRLTKLWNMRIKG-
CPKLEESFTNYS----QWSKISHISNIELGGWR------RTA       3877
chc1_BAC_B07-1C15           LVSLQELHLQNCEKLENLPSRDAMRRLTKLWNLQIRG-CPKLGESCTN-
S----QRSKISHISNIEVGGRII-----DDR       3754
```

FIG. 14AC

```
chc2_BAC_B07-1C15       LVSLEELYLQDCEKLEHLPSRDAMRRLTKLWNLEIKG-CPKLEESCTN-
S----QWSKISHIPNIEVGGRII-----KDR         3754
chc_RGC1_BAC_2D06-3D21  LVSLQELYLQNCEKLEHLPSRDAMRRLTKLWNLRIIEGCPKLEESCTN-
S----QWSKISHIPNIEVGGRII-----KDR         3712
chc_RGC2_BAC_2D06-3D21  PVSLEELYLQDCEKLEHLPSRDAIRRLTKLWNLGIEG-CPKLEENCIN-
S----QWSKISHIRNIEVGGRII-----KDR         3424
RH122B15 c247
2959
RH122B15 c88-5          LVSLEELTLRNCEKLEHLPSQDAMRHLTKLQSLKIKG-
CPKLEESCNNRSGPNSQWSNISHIPKVKVGRSII-----QDL              3706
RH137D14 c13-1          LVSLQELHLQSCEKLENLPSRDAMRRLTKLWNLEIIG-CPKLEESCTN-
S----QRSKISHISYIEVGGMII-----NDR         3949
RH137D14 c13-2          IVSLEELYLQDCEKLEHLPSRDAMRRLTKLWNMRIKG-
CPKLEESFTNYS----QWSKISHISNIELGGWR------RTT              3860
RH77023 c579-4          LVSLEELRLENCEKLEHLPSREAMRRLTKLWYLKIKG-
CPKLEESCNNRSGPNTQWSNISHIPKVKVGGSII-----QDL              3748
RH77023 c579-5          LVTLELLHLENCSKLEYLPSRDTMRHLKKLQSLQING-
CPKLEESCTNRSGPNSQWSNISHIQRIEVGRIP-----LYQC              3736
RH77023 c671
3358
RH77023 c706-3          LVSLVELSLSNCKNLQHLPSRDAMRRLTKLRRLWIKG-
CPQLEESCTNRSGPNSQWSKISHIPQISVEFTT-----IQDL              3703
RH77023 c706-4          LVTLQQLTLWNSKKLEHLPC.
3586
ph2 candidate           LASLEQLLILNCKKLEHLPSRDAMRRLTKLRILHIVG-
CPQLGESCTKQSGPNSQWSKISHIPDIEVGAFMKITEAMARL              1239

Majority        ISLGFSFTF----------------------------------------
-------------------------
---------------------------------+----------+----------+----------+---------
+-------------------+---------+             1370      1380      1390      1400
   1410      1420      1430      1440
-----------------------------------~~~~~~~~~~+~~~~~~~~~~+~~~~~~~~~~+~~~~~~~~~~
+-------------------+
94-2031_L4_L7_L8        ISLGFSFTF.
3907
324-2_J1_J3_J8          ISLGFSFTF.
3907
324-2_J2_J5_J6          ISLGFSFTF.
3910
487-1_I4_I6_I8          ISLGFSFTF.
3910
493-5_F1_F5_F7          ISLGFSFTF.
3910
493-7_G2                ISLGFSFTF.
3910
493-7_G10               VSLGFSFTF.
3910
493-7_G12               ISLGFSFTF.
3910
493-7_G14_G22           CKCWFLFHFLN
3898
493-7_G19               ISLGFSFTF.
3910
493-7_G21               CKCWFLFHFLN
3898
493-9_H5_H30            VSLGFSFTF.
3904
493-9_H11_H19_H27       ISLGFSFTF.
3910
```

FIG. 14AD

```
543-5_C2                ISLGFSFTF.
3910
561-2_K4_K14_K22        ISLGFSFTF.
3907
561-2_K6_K30_K31        XKCWFLFHFLN
3898
849-1_M8_M18_M20        ISLGFSFTF.
3910
852-5_E14_E23           ISLGFSFTF.
3910
852-5_E28               ISLGFSFTF.
3907
852-5_E30               ISLGFSFTF.
3913
RH_D3_D4_D7             ISLGFSFTF.
3910
Rpi-chc1_ORF            ISLGFSFTF.
3907
chc1_BAC_B07-1C15
QYYFPRVPEKKFCTMVKGTDWNVVDIGAVGDSGCTKLENSSFLVETTVCIDGPCRDVFGNVRCMFIPYYFHRIVHA
NVYP         3994
chc2_BAC_B07-1C15       CAKMKIMG-------------------------------------
-------------------------------- 3778
chc_RGC1_BAC_2D06-3D21  RTTT--VHS-----------------LWD----------------
-------------------------------- 3742
chc_RGC2_BAC_2D06-3D21  HYQS-----------------------------------------
-------------------------------- 3436
RH122B15 c247
2959
RH122B15 c88-5          PQTPSGPTNIS----------------------------------
-------------------------------- 3739
RH137D14 c13-1          QYYFPRVPEK---------------K-------------------
-------------------------------- 3982
RH137D14 c13-2          ISLGFSFTF.
3910
RH77O23 c579-4          HKSHF.
3786
RH77O23 c579-5          LSKSLFLFQFPSRIF.
3784
RH77O23 c671
3358
RH77O23 c706-3          RKFLFLFSFQSFSFN------------------------------
-------------------------------- 3748
RH77O23 c706-4
3586
ph2 candidate           IGETLEVTEPFHRKFDARQIPFGTEI
1265

Majority     ---------------------------------------------
---------------------
----------------+-----------------+-----------+
                                           1450      1460      1470      1480
1490      1500      1510      1520
                        ----------+-----------+-----------+----------
+-----------+-------------+----------+
94-2031_L4_L7_L8
3907
324-2_J1_J3_J8
3907
324-2_J2_J5_J6
3910
```

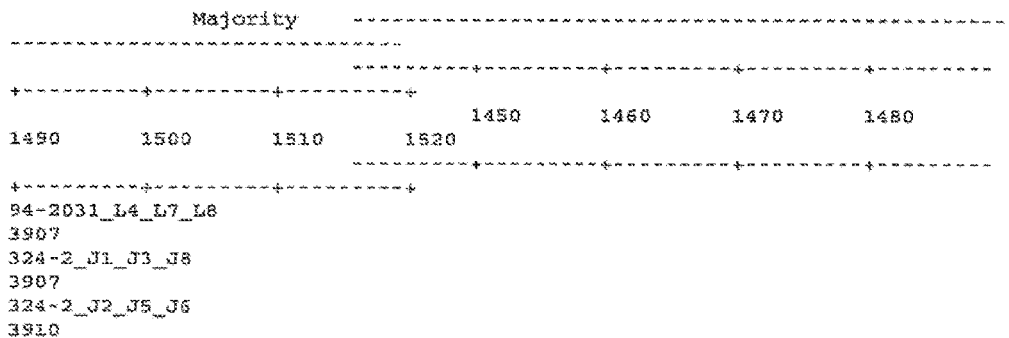

FIG. 14AE

```
487-1_I4_I6_I8
3910
483-5_F1_F5_F7
3910
493-7_G2
3910
493-7_G10
3910
493-7_G12
3910
493-7_G14_G22
3898
493-7_G19
3910
493-7_G21
3898
493-9_H5_H30
3904
493-9_H11_H19_H27
3910
543-5_C2
3910
561-2_K4_K14_K22
3907
561-2_K6_K30_K31
3898
849-1_M8_M18_M20
3910
852-5_E14_E23
3910
852-5_E28
3907
852-5_E30
3913
RH_D3_D4_D7
3910
Rpi-chc1_ORF
3907
chc1_BAC_B07-1C15
GLEKLRITDCPLLKSIPNQFEILRELRIBGVDSEMLLLNLCSNLTSLVHLAVSNVKELTCLPDEMLRNNVSLQHIM
IFRC        4234
chc2_BAC_B07-1C15                 -------------------------------QIAT--------
-------------------------------    3790
chc_RGC1_BAC_2D06-3D21            -------------------------------TFMG--------
-------------------------------    3754
chc_RGC2_BAC_2D06-3D21            -------------------------------IAS---------
-------------------------------    3445
RH122B15 c247
2959
RH122B15 c88-5                    ----------------
-------------------------------    3739
RH137D14 c13-1           -FY------------------------------ICS--------
-------------------------------    3997
RH137D14 c13-2
3910
RH77023 c579-4
3766
RH77023 c579-5
3784
RH77023 c671
3358
RH77023 c706-3                    ----------------
-------------------------------    3748
```

FIG. 14AF

```
RH77023 c706-4
3586
ph2 candidate
1265

Majority      ------------------------------------------------
---------------------------------
          -----------+---------+-----------+-----------+----------
+----------+---------+-----------+
                                    1530       1540       1550       1560
1570       1580       1590       1600
                                 ---------+---------+-----------+-----------
+----------+---------+-----------+
94-2031_L4_L7_L8
3907
324-2_J1_J3_J8
3907
324-2_J2_J5_J6
3910
487-1_I4_I6_I8
3910
493-5_F1_F5_F7
3910
493-7_G2
3910
493-7_G10
3910
493-7_G12
3910
493-7_G14_G22
3898
493-7_G19
3910
493-7_G21
3898
493-9_H5_H30
3904
493-9_H11_H19_H27
3910
543-5_C2
3910
561-2_K4_K14_K22
3907
561-2_K6_K30_K31
3898
849-1_M8_M18_M20
3910
852-5_E14_E23
3910
852-5_E28
3907
852-5_E30
3913
RH_D3_D4_D7
3910
Rpi-chc1_ORF
3907
chc1_BAC_B07-1C15
GEFRELPQSLYNLHSLKRLEISSCINFSSFPVPRGDNYLTSLQLFHLCVPEVGIHRLTGLRGLEIGPFSEMVDFDA
FQLI    4474
chc2_BAC_B07-1C15    ------------------------------------------------
------------------------------    3790
```

FIG. 14AG

```
561-2_K4_K14_K22
3907
561-2_K6_K30_K31
3898
849-1_M8_M18_M20
3910
852-5_E14_E23
3910
852-5_E28
3907
852-5_E30
3913
RH_D3_D4_D7
3910
Rpi-chc1_ORF
3907
chc1_BAC_B07-1C15
FNGIQQLLSLCDLAVYGRGHWDSLPYQIMQLSDLREITIADFGIEALPPRLDNLTSLERLSLAGCKRLQHLNFSDA
MPKL    4714
chc2_BAC_B07-1C15       ------------------------------------------------
-----------------------------    3798
chc_RGC1_BAC_2D06-3D21  ------------------------------------------------
-----------------------------    3754
chc_RGC2_BAC_2D06-3D21  ------------------------------------------------
-----------------------------    3445
RH122B15 c247
2959
RH122B15 c88-5          ------------------------------------------------
-----------------------------    3739
RH137D14 c13-1          ------------------------------------------------
-----------------------------    4000
RH137D14 c13-2
3910
RH77O23 c579-4
3766
RH77O23 c579-5
3784
RH77O23 c671
3358
RH77O23 c706-3          ------------------------------------------------
-----------------------------    3748
RH77O23 c706-4
3586
ph2 candidate
1265

Majority    ------------------------------------------------
-----------------------------
                                ---------+---------+---------+---------+---------
+---------+---------+---------+         1690      1700      1710      1720
  1730      1740      1750      1760
                                ---------+---------+---------+---------+---------
+---------+---------+---------+
94-2031_L4_L7_L8
3907
324-2_J1_J3_J8
3907
324-2_J2_J5_J6
3910
487-1_I4_I6_I8
3910
```

FIG. 14AI

```
493-5_F1_F5_F7
3910
493-7_G2
3910
493-7_G10
3910
493-7_G12
3910
493-7_G14_G22
3898
493-7_G19
3910
493-7_G21
3898
493-9_H5_H30
3904
493-9_H11_H19_H27
3910
543-5_C2
3910
561-2_K4_K14_K22
3907
561-2_K6_K30_K31
3898
849-1_M8_M18_M20
3910
852-5_E14_E23
3910
852-5_E28
3907
852-5_E30
3913
RH_D3_D4_D7
3910
Rpi-chc1_ORF
3907
chc1_BAC_B07-1C15
WLLWISDCPLLEALSDGLGNLVSLEDLYIGNCKKLEHLPSRDAMQHLTKLRNLRIEGCPKLEENCTNSQWSKISHI
PRIN        4954
chc2_BAC_B07-1C15     --------------------------------------------------------------
---------------------------------    3790
chc_RGC1_BAC_2D06-3D21 -------------------------------------------------------------
---------------------------------    3754
chc_RGC2_BAC_2D06-3D21 -------------------------------------------------------------
---------------------------------    3445
RH122B15 c247
2989
RH122B15 c88-5         -----------------------------
---------------------------------    3739
RH137D14 c13-1         -----------------------------
---------------------------------    4000
RH137D14 c13-2
3910
RH77O23 c579-4
3766
RH77O23 c579-5
3784
RH77O23 c671
3358
RH77O23 c706-3         ------------------------------------------------------------
---------------------------------    3748
RH77O23 c706-4
3586
```

FIG. 14AJ

```
ph2 candidate
1265

Majority       --------------------------------------------
-------------------------
                        ------------+-----------+-----------+-----------+
+------------+-----------+-----------+             1770        1780        1790        1800
      1810        1820        1830        1840
                        ------------+-----------+-----------+-----------+
+------------+-----------+-----------+
94-2031_L4_L7_L8
3907
324-2_J1_J3_J8
3907
324-2_J2_J5_J6
3910
487-1_I4_I6_I8
3910
493-5_F1_F5_F7
3910
493-7_G2
3910
493-7_G10
3910
493-7_G12
3910
493-7_G14_G22
3898
493-7_G19
3910
493-7_G21
3898
493-9_H5_H30
3904
493-9_H11_H19_H27
3910
543-5_C2
3910
561-2_K4_K14_K22
3907
561-2_K6_K30_K31
3898
849-1_M8_M18_M20
3910
852-5_E14_E23
3910
852-5_E28
3907
852-5_E30
3913
RH_D3_D4_D7
3910
Rpi-chc1_ORF
3907
chc1_BAC_B07-1C15
VDGRTIKDRHYQSVLCFQHFACPLELNCSSSNSSSMVAGSKRLCGKSSQIVTRGTTSVILYEEQHSTVDSLWDTLM
SIWV    5194
chc2_BAC_B07-1C15              ------------FCFSGDCG---------------
                                        3814
chc_RGC1_BAC_2D06-3D21         ------------IWVLNNLFG--------------
-------------------------               3781
```

FIG. 14AK

```
493-5_F1_F5_F7
3910
493-7_G2
3910
493-7_G10
3910
493-7_G12
3910
493-7_G14_G22
3898
493-7_G19
3910
493-7_G21
3898
493-9_H5_H30
3904
493-9_H11_H19_H27
3910
543-5_C2
3910
561-2_K4_K14_K22
3907
561-2_K6_K30_K31
3898
849-1_M8_M18_M20
3910
852-5_E14_E23
3910
852-5_E28
3907
852-5_E30
3913
RH_D3_D4_D7
3910
Rpi-chc1_ORF
3907
chc1_BAC_B07-1C15
CFSGDCGCTKLESSSNAPCVGCVSVSSLAREIAICKLICIWQNVNWRSRKGSKEQLLPVTLLDFSTMYMGHIGTFC
ISGA          5611
chc2_BAC_B07-1C15            ----TFICSRSQGSGN---------RHIK------------------
---------------NKKRHGLRFDITFQGA          4021
chc_RGC1_BAC_2D06-3D21       CFSGDCGCTKLESLSMGLVEMQLSDLREIEIADFGIEAFPPRLDN-----
--------LISLERLTLVRCKRLQHLNFSDA           4207
chc_RGC2_BAC_2D06-3D21       -----ERQCGKSS.
3965
RH122B15 c247
2959
RH122B15 c88-5               FRIFRCSCTFMEGDVDIFVRFYKRHKMYWHNT.
4006
RH137D14 c13-1               ----DSGCTKLENSR-------------------------
-------------------TISP------FIKTSA         4147
RH137D14 c13-2
3910
RH77O23 c579-4
3756
RH77O23 c579-5
3784
RH77O23 c671
3358
RH77O23 c706-3
3832
RH77O23 c706-4
3586
```

FIG. 14AN

```
ph2 candidate
1265

Majority    -------------------------------------------------
-------------------------------
                                    ----------+----------+----------+----------+----------
+----------+----------+----------+
                              2010       2020       2030       2040
    2050       2060       2070       2080
                                    ----------+----------+----------+----------+----------
+----------+----------+----------+
94-2031_L4_L7_L8
3907
324-2_J1_J3_J8
3907
324-2_J2_J5_J6
3910
487-1_I4_I6_I8
3910
493-5_F1_F5_F7
3910
493-7_G2
3910
493-7_G10
3910
493-7_G12
3910
493-7_G14_G22
3898
493-7_G19
3910
493-7_G21
3898
493-9_H5_H30
3904
493-9_H11_H19_H27
3910
543-5_C2
3910
561-2_K4_K14_K22
3907
561-2_K6_K30_K31
3898
849-1_M6_M18_M20
3910
852-5_E14_E23
3910
852-5_E28
3907
852-5_E30
3913
RH_D3_D4_D7
3910
Rpi-chc1_ORF
3907
chc1_BAC_B07-1C15
FGDLGYIIKWAGSAKMVTEQLQQEVTIFGGIKFFKFRFFFFGESTLPIAPIGVHQSLKKTCATTLRRLSEGANTT
5836
chc2_BAC_B07-1C15        AN------
WMPTSWRRAIPPLVQSSLERGRFETAKKSKFIFKVKDDVFYPTTQNLSRFRTFVVLEDKRNL.
4216
```

Figure 14A:
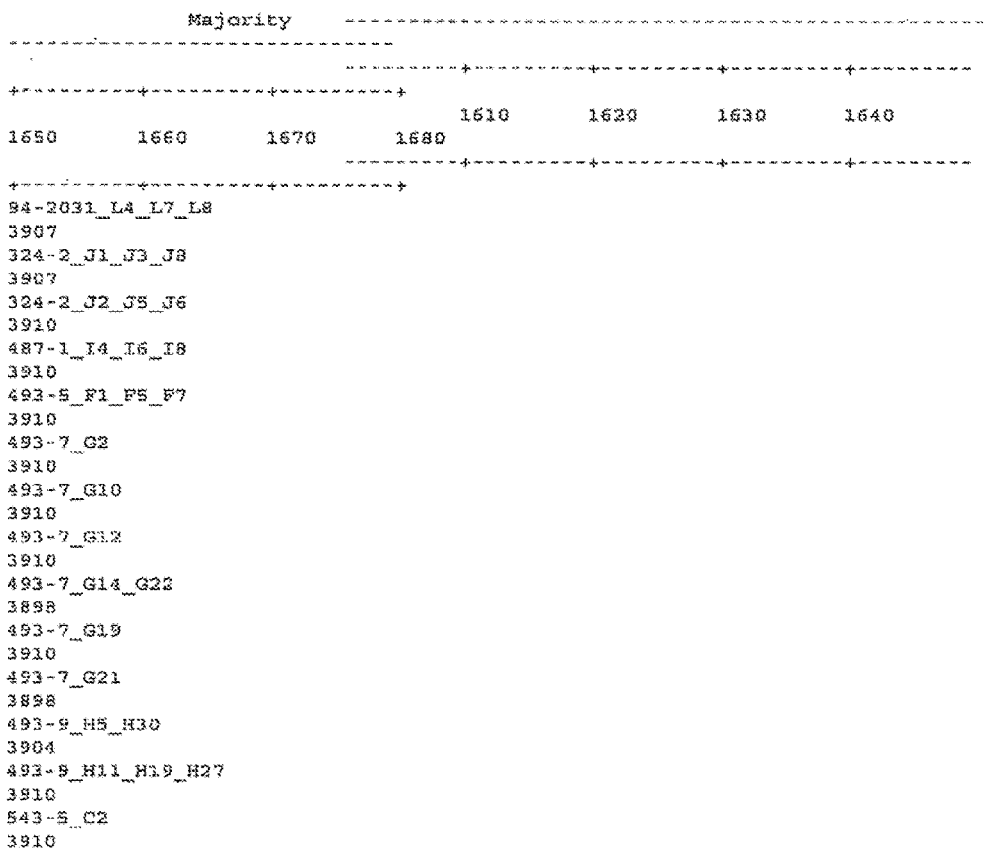
Figure 14A:
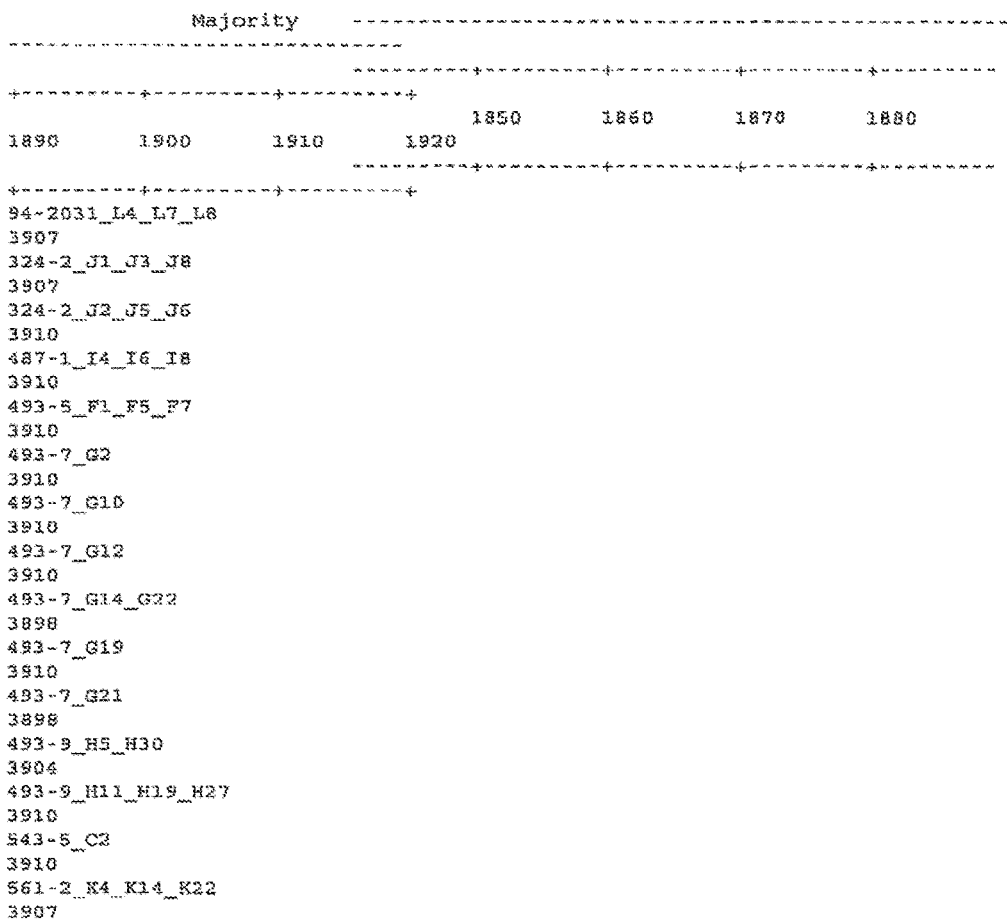
Figure 14A:
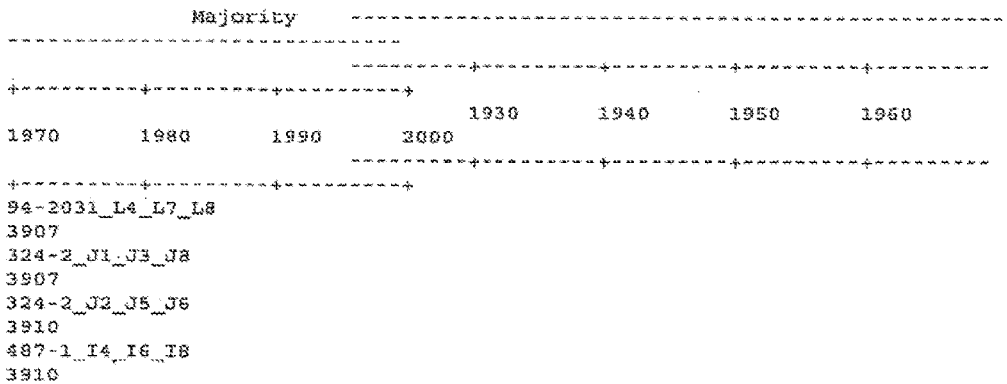

FIG. 14AO chc_RGC1_BAC_2D06-3D21
MPKLQDLWINDCPLLEALLDGLRNLVSLQELRLRNYEKLEHLPSRDAMRRLTKLWKLDIIGCPKLQESCTNSQWSK
ISHI        4447
chc_RGC2_BAC_2D06-3D21
3565
RH122B15 c247
2959
RH122B15 c86-5
4006
RH137D14 c13-1                    N---------------EGLQQR.
4171
RH137D14 c13-2
3910
RH77O23 c579-4
3766
RH77O23 c579-5
3784
RH77O23 c671
3358
RH77O23 c706-3
3832
RH77O23 c706-4
3586
ph2 candidate
1265

Majority     -----------
                         -----------+
                                    2090
                         -----------+

94-2031_L4_L7_L8
3907
324-2_J1_J3_J8
3907
324-2_J2_J5_J6
3910
487-1_I4_I6_I8
3910
493-5_F1_F5_F7
3910
493-7_G2
3910
493-7_G10
3910
493-7_G12
3910
493-7_G14_G22
3898
493-7_G19
3910
493-7_G21
3898
493-9_H5_H30
3904
493-9_H11_H19_H27
3910
543-5_C2
3910
561-2_K4_K14_K22
3907
561-2_K6_K30_K31
3898

FIG. 14AP

```
649-1_M8_M18_M20
3910
852-5_E14_E23
3910
852-5_E28
3907
852-5_E30
3913
RH_D3_D4_D7
3910
Rpi-chc1_ORF
3907
chc1_BAC_B07-1C15
5836
chc2_BAC_B07-1C15
4216
chc_RGC1_BAC_2D06-3D21      PRIEVVLNE.
4477
chc_RGC2_BAC_2D06-3D21
3565
RH122B15 c247
2959
RH122B15 c98-5
4006
RH137D14 c13-1
4171
RH137D14 c13-2
3910
RH77O23 c579-4
3766
RH77O23 c579-5
3784
RH77O23 c671
3358
RH77O23 c706-3
3832
RH77O23 c706-4
3586
ph2 candidate
1265
```

FIG. 14AQ

CLONING AND EXPLOITATION OF A FUNCTIONAL R-GENE FROM *SOLANUM CHACOENSE*

CROSS-REFERENCE TO RELATED APPLICATIONS

This application is the national phase of PCT application PCT/NL2010/050612 having an international filing date of 20 Sep. 2010, which claims benefit of European patent application No. 09170769.5 filed 18 Sep. 2009. The contents of the above patent applications are incorporated by reference herein in their entirety.

REFERENCE TO SEQUENCE LISTING SUBMITTED VIA EFS-WEB

The entire content of the following electronic submission of the sequence listing via the USPTO EFS-WEB server, as authorized and set forth in MPEP §1730 II.B.2(a)(C), is incorporated herein by reference in its entirety for all purposes. The sequence listing is identified on the electronically filed text file as follows:

| File Name | Date of Creation | Size (bytes) |
|---|---|---|
| 313632013300Seqlist.txt | May 29, 2012 | 2,855,654 bytes |

FIELD OF THE INVENTION

The invention relates to a resistance gene isolated from *S. chacoense*. Moreover, the invention relates to the use of said resistance gene, for example to clone functional homologues, and the use of said resistance gene(s) in a method to increase or confer at least partial resistance to an oomycete infection in a plant. More in specific the invention provides a resistance gene that is capable of increasing or conferring at least partial resistance to *Phytophthora sp.* (for example *Phytophthora infestans*) through genetic engineering techniques or through marker assisted breeding techniques

BACKGROUND

Late blight, caused by the oomycete *Phytophthora infestans*, is one of the most serious diseases in worldwide potato production. It was responsible for the Irish potato famine of the mid-19th century, resulting in the death of one million people. Although a lot of effort has been invested in controlling the pathogen, chemical control of *P. infestans* is still the main crop management strategy, but environmental safety is becoming more important and the pathogen is sometimes able to evolve resistance to the fungicide treatment. Therefore, introduction of resistance into modern potato varieties is the most durable strategy to control the disease.

In the last century, *Solanum demissum*, which is a hexaploid Mexican species, was extensively used in breeding for late-blight resistance in potato. Initially, a series of 11 R genes derived from *S. demissum* was described. Of these, R1, R2, R3a/b, R6, and R7 have been localized on the genetic maps of potato (*Solanum tuberosum*). However, these R genes confer pathovar-specific resistance and those that were introgressed into potato varieties, mainly R1, R2, R3, R4, and R10, were quickly overcome by the pathogen. Hence, new sources for resistance are required, and currently, several other wild *Solanum* species have been reported as being potential sources of resistance, many of which have been genetically characterized (Table 6).

Recent efforts to identify late blight resistance have focused on major R genes conferring broad-spectrum resistance derived from diverse wild *Solanum* species. Beside *S. demissum*, other wild *Solanum* species such as *S. acaule, S. chacoense, S. berthaultii, S. brevidens, S. bulbocastanum, S. microdontum, S. sparsipilum, S. spegazzinii, S., stoloniferum, S. sucrense, S. toralapanum, S. vernei* and *S. verrucosum* have been reported as new sources for resistance to late blight (reviewed by (Jansky, 2000)).

*S. chacoense*, is a self-incompatible diploid species from South America, and is thought to be a source for late-blight resistance. A recent taxonomic rearrangement of the section Petota revealed its relationship with species like *S. berthaultii* and *S. tarijense*. Several accessions of *S. chacoense* (CHC543-1), *S. berthaultii* (BER481-3, BER94-2031) and *S. tarijense* (TAR852-5) have been tested in detached leaf assays (DLA) with multiple isolates (Table 5) and in repeated field trials with isolate IPO-C. In all tests CHC543-5, BER94-2031, BER481-3 and TAR852-2 remained unaffected, underscoring the relevance of the expressed R genes for resistance breeding.

Molecular cloning of the genes responsible for resistance and subsequent introduction of the genes into potato varieties is a third method that circumvents many of the problems encountered in the previous two strategies.

To date, multiple late blight R-genes have been cloned, like the allelic genes RB and Rpi-blb1 on chromosome 8 and Rpi-blb2 on chromosome 6 (Table 6). Recently, also an Rpi-blb3 resistance gene has been isolated (WO 2008/091153). Although the initial results obtained with RB and Rpi-blb1, -2 and -3 are promising, there is a further need for additional R-genes.

SUMMARY OF THE INVENTION

The invention now relates to a method for providing at least partial resistance or increasing resistance in a plant against an oomycete infection comprising providing a plant or a part thereof with a nucleic acid encoding the amino acid sequence Rpi-chc1 of FIG. 4A-K or a functional fragment or a functional homologue thereof, preferably wherein said plant is a plant from the Solanaceae family, more preferably *Solanum tuberosum*. Preferably said oomycete comprises *Phytophthora*, more preferably *Phytophthora infestans*. In a specific embodiment, the above mentioned functional homologue is selected from the group of amino acid sequences consisting of 493-7_G12, 543-5_C2, 849-1_M8_M18_M20, 487-1_I4_I6_I8, 94-2031_L4_L7_I8, 561-2_K4_K14_K22, 324-2_J1_J3_J8, 852-5_E14_E23, 852-5_E28, 493-9_H5_H30, 493-7_G14_G22, 561-2_K6_K30_K31 and 493-7_G21. In a further specific embodiment the nucleic acid sequence as defined above comprises a nucleic acid sequence as depicted in FIG. 7A-B or a nucleic acid sequence encoding the amino acid sequences 493-7_G12, 543-5_C2, 849-1_M8_M18_M20, 487-1_I4_I6_I8, 94-2031_L4_L7_I8, 561-2_K4_K14_K22, 324-2_J1_J3_J8, 852-5_E14_E23, 852-5_E28, 493-9_H5_H30, 493-7_G14_G22, 561-2_K6_K30_K31 and 493-7_G21 as depicted in FIG. 13A-T.

The invention further comprises a method for breeding an oomycete, preferably a *Phytopthora* resistant tetraploid plant, comprising a. increasing the ploidy level of the gametes of a diploid plant that already contains a nucleic acid sequence as defined above;

b. using said gametes in a cross with gametes of a tetraploid plant; and c. selecting the offspring of said cross for the presence of said nucleic acid sequence. Preferably in such a method the diploid plant of step a) is plant from the genus S. chocaense, S. berthaultii, S. sucrense, or S. tarijense.

The invention also relates to a method for selecting a plant or plant material or progeny thereof for its susceptibility or resistance to an oomycete infection, said method comprising the steps of testing at least part of said plant or plant material or progeny thereof for the presence or absence of a nucleic acid as defined above. Specifically in such a method the testing involves detecting the presence of one or more of the markers of Table 2 and 8 and it is performed with a primer or a probe that specifically binds to said nucleic acid.

Hence, the invention also relates to a marker for marker assisted selection in plant breeding to obtain resistance against oomycetes, wherein said marker is chosen from the markers presented in Table 2 and 8.

In another embodiment, the invention relates to an isolated or recombinant nucleic acid sequence comprising a nucleic acid sequence encoding the amino acid sequence Rpi-chc1 of FIG. 4A-K or a functional fragment thereof, or a nucleic acid encoding the amino acid sequence of 493-7_G12, 543-5_C2, 849-1_M8_M18_M20, 487-1_I4_I6_I1, 94-2031_L4_L7_18, 561-2_K4_K14_K22, 324-2_J1_J3_J8, 852-5_E14_E23, 852-5_E28, 493-9_H5_H30, 493-7_G14_G22, 561-2_K6_K30_K31 and 493-7_G21 or a functional fragment thereof. Preferably said fragment comprises at least the LRR domain of the amino acid sequence. It is further a preferred embodiment where the isolated or recombinant nucleic acid sequence according to claim 10 comprising a nucleic acid sequence as depicted in FIG. 7A-B or in FIG. 13A-T.

The invention further relates to a transgenic or tetraploid cell comprising a nucleic acid according to the invention.

Also part of the invention is a vector comprising a nucleic acid sequence according to the invention. Preferably said vector further comprises the promoter and/or terminator to which the gene is naturally associated, more preferably a truncated promoter having less than 1000 nucleotides upstream of the gene sequence.

The invention also is related to a transgenic or tetraploid host cell comprising a nucleic acid according to the invention or a vector according to the invention, preferably wherein such a host cell is an Agrobacterium cell or a plant cell. The invention also relates to a transgenic or tetraploid plant cell comprising a nucleic acid according to the invention or a vector according to the invention, preferably wherein said plant cell is a cell from a Solanaceae, more preferably Solanum tuberosum, more preferably a tetraploid Solanum tuberosum. In a further embodiment the invention comprises a transgenic or tetraploid plant comprising such a cell and also a part derived from such a plant, preferably wherein said part is a tuber.

Also comprised in the current invention is a protein encoded by an isolated or recombinant nucleic acid according to the invention or a functional fragment thereof, preferably wherein said protein has the amino acid sequence of Rpi-chc1 as depicted in FIG. 4A-K.

The invention also relates to an antibody that (specifically) binds to the protein of claim 20.

LEGENDS TO THE FIGURES

FIG. 1. Genetic and physical maps of the Rpi-chc1 (A) and Rpi-ber (B) loci (7650 and 06-882 populations respectively).

Indicated are the relative positions of markers, the number of recombinants identified between markers, overlapping BAC clones that span the R-loci, and the relative positions of RGAs in the CHC543-5 and RH89-039-16 physical maps.

FIG. 2. Chr10 BAC sequence annotation.

Two tiling paths consisting of 3 and 4 overlapping BACs from RH89-039-16 (RH106G038, RH137D014, RH009D021 and RH122B15, RH77O23, RH04G12, RH199E15) and two overlapping BACs from CHC543-5 were sequenced and annotated. Positions of markers and BAC end sequences from overlapping BACs are indicated by arrow heads. Positions of sequence contigs are indicated by horizontal arrows. Positions of genes, as predicted by the FGENESH algorithm, are indicated by colored boxes. Protein sequence homology, as found by BlastP search against the NR database is indicated by vertical arrows. RGAs are numbered by underlined figures and their gene structure are numbered correspondingly A: RH106G03, B: RH137D14, C: RH97D21, D: RH122B15, E: RH77O23, F: CHC B1 (B07-1-05), G: CHC B2 (2-D06_3-D21).

FIG. 3. Transient complementation of Phytophthora susceptibility in Nicotiana benthamiana leaves. Two days after agro-infiltration the leaves were challenged by the inoculation with a zoospore suspension of P. infestans isolate 90128 (avirulent on CHC543-5) in a detached leaf assay. Typical disease phenotypes developed 6 days after inoculation of control plants that had been agro-infiltrated with pBINplus without an insert. Full resistance was observed in control plants agroinfiltrated with pBINplus:Rpi-blb1. Agroinfiltration of pBINplus:CHCB2-3, one of three RGAs from the Rpi-chc1 mapping interval, also conferred full resistance to infection by P. infestans, while pBINplus:CHCB2-1 and pBINplus:CHCB2-2 infiltrated leaves remained susceptible.

Figure 4A:
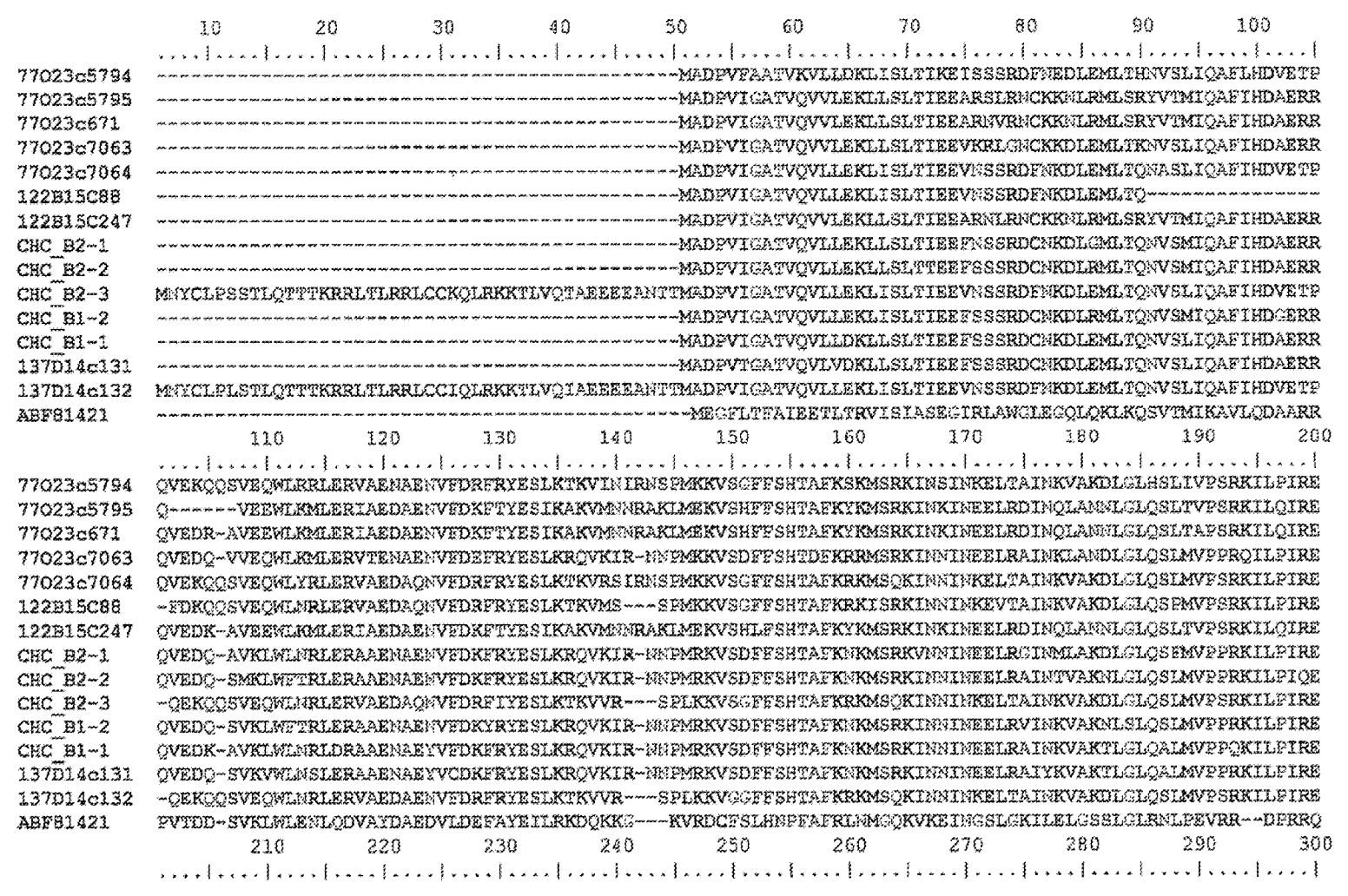
Figure 4B:
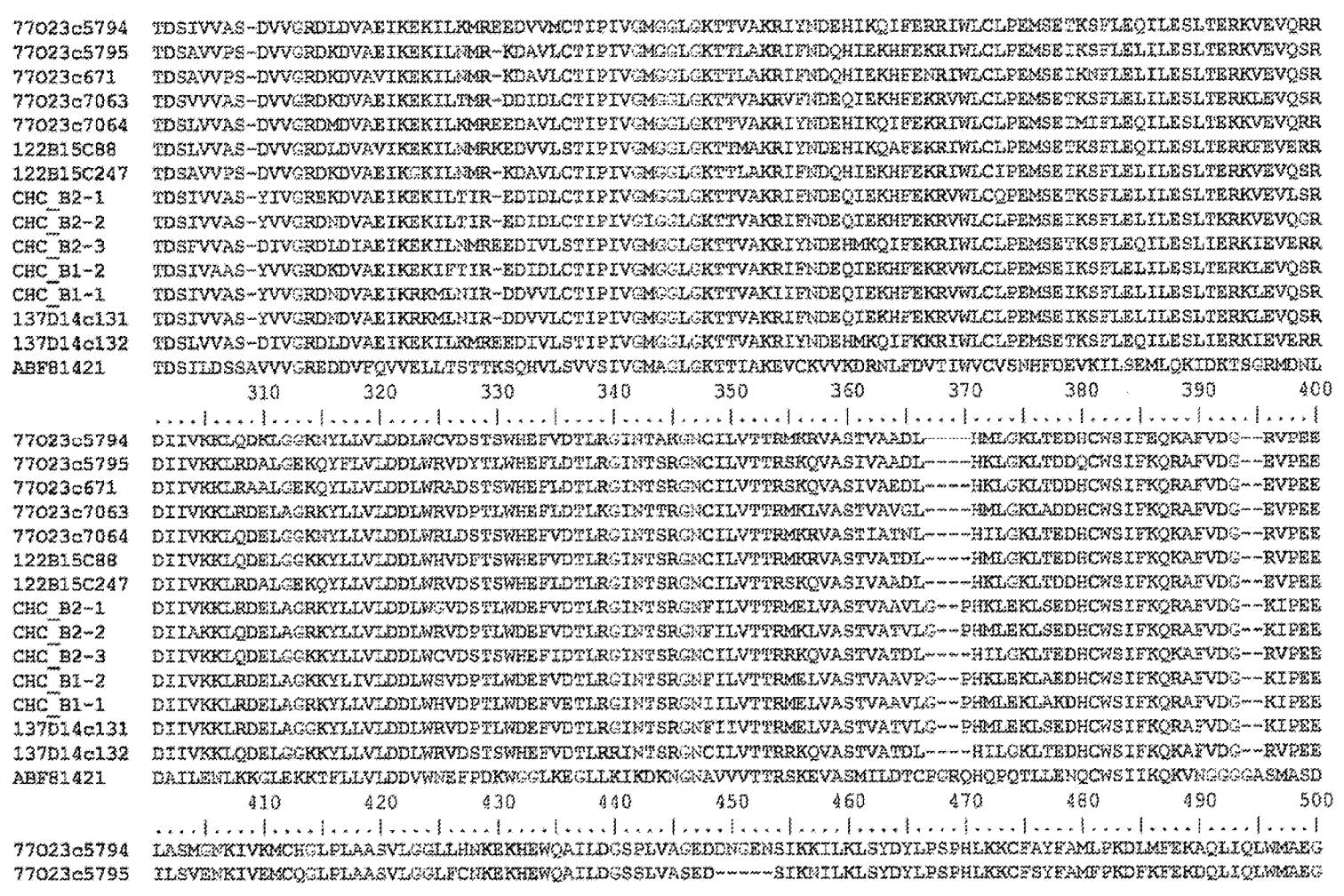
Figure 4C:
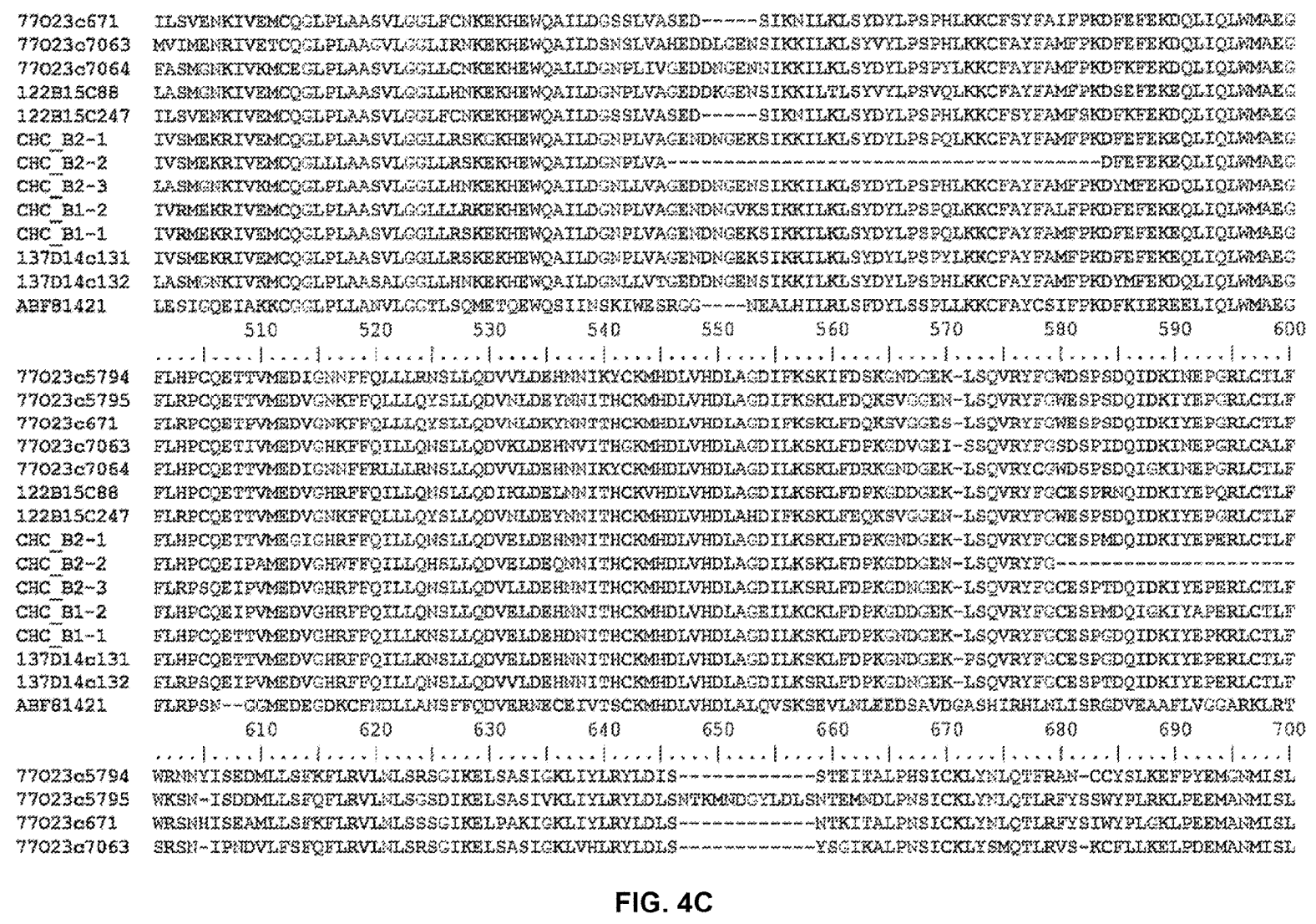
Figure 4D:
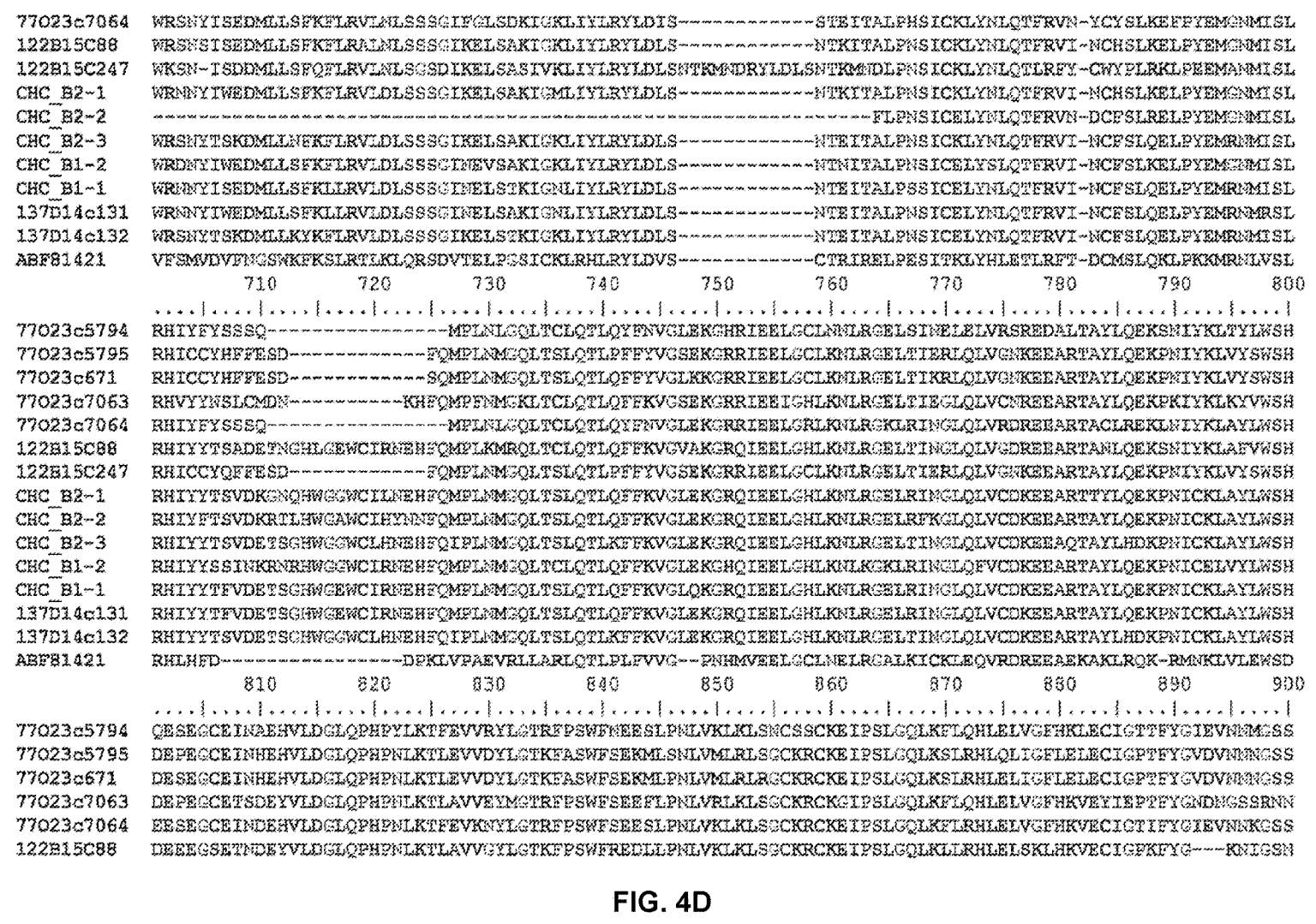
Figure 4G:
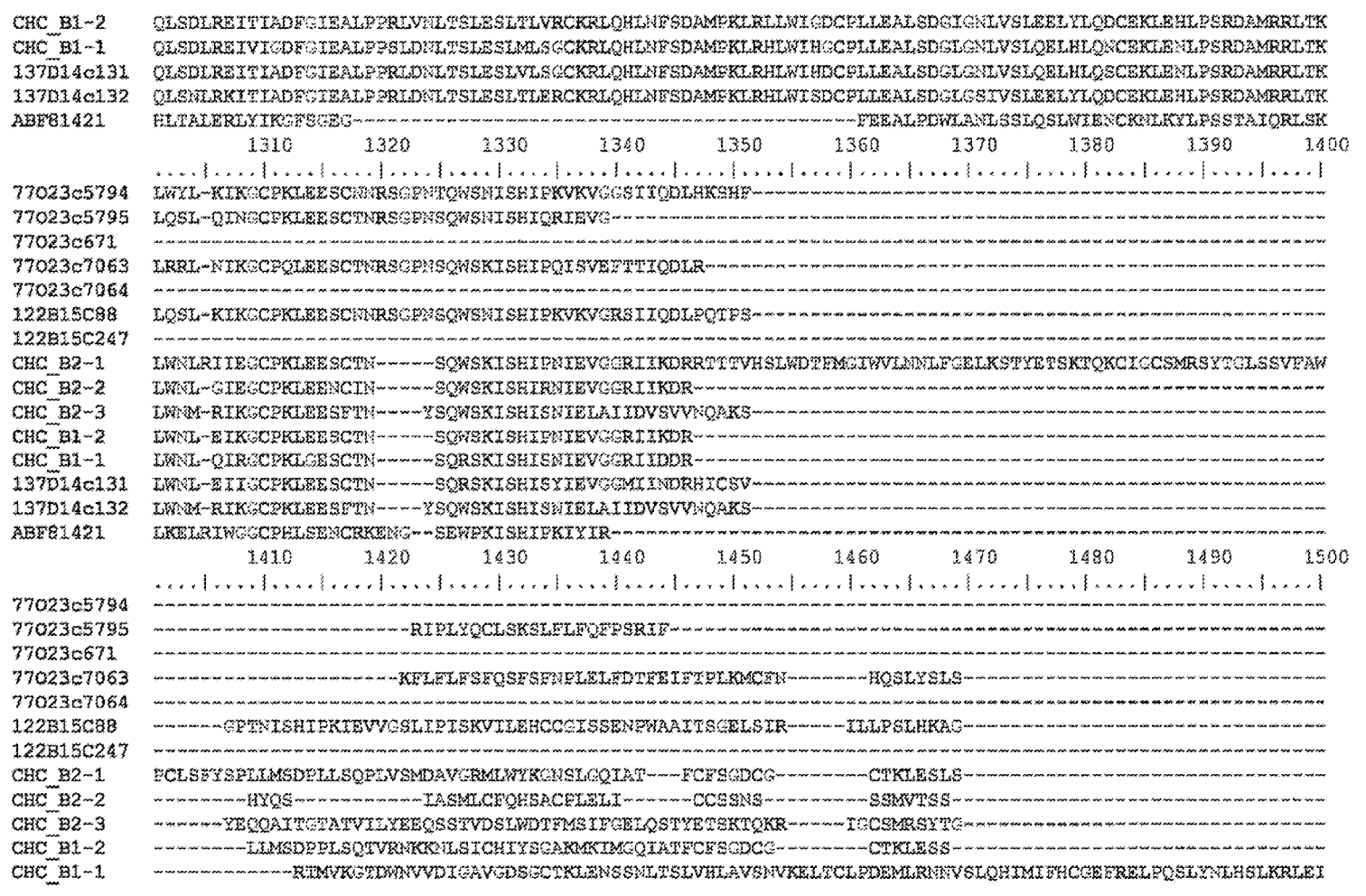
Figure 4H:
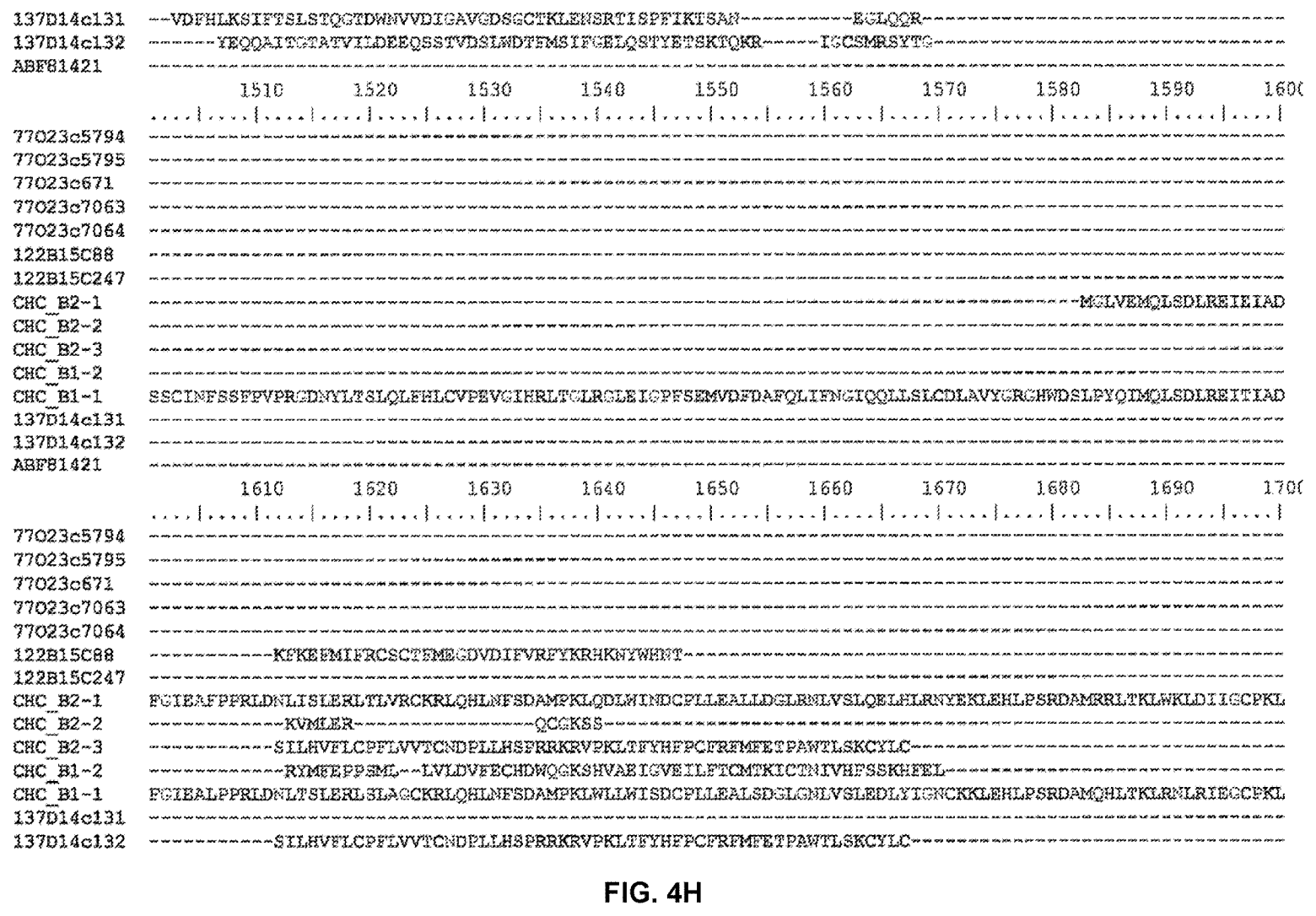

FIG. 4A-K. Amino acid sequence alignment of RGAs from S. chacoense (CHC B1-1 (SEQ ID NO:124), CHC_B1-2 (SEQ ID NO:122), CHC_B2-1 (SEQ ID NO:123), CHC_B2-2 (SEQ ID NO:121), and CHC_B2-3=Rpi-chc1 (SEQ ID NOS:110,126)) and from related sequences deriving from S. tuberosum accession RH89-039-16 (77O23c5794 (SEQ ID NO:111), 77O23c5795(SEQ ID NO:115), 77O23c671 (SEQ ID NO:112), 77O23c7063 (SEQ ID NO:116), 77O23c7064 (SEQ ID NO:113), 122B15C88 (SEQ ID NO:117), 122B15C247 (SEQ ID NO:114), 137D14c131 (SEQ ID NO:119), and 137D14c132 (SEQ ID NO:120)).

The protein with unknown function, ABF81421 (SEQ ID NO:118), is encoded by a gene from Populus trichocarpa.

FIG. 5. Rpi-chcc 1 protein domain organization (SEQ ID NO:110). The N-terminal CC-domain comprises amino acids 1-231. The amino acids depicted in shading are predicted to fold into a coiled structure using the "COIL" algorithm with window size 14. The central domain NB-ARC domain comprises amino acids 232-557. Domains in shading show similarity to the previously described Kinase 1a, Kinase 2, kinase 3a, GLPL, RNBS-D and MHD domains, respectively. The C-terminal LRR-domain consists of 29 imperfect leucine rich repeats. Conserved hydrophobic amino acids (A, V, L, and F) herein are marked by shading. The consensus is shown at the bottom.

Figure 6:
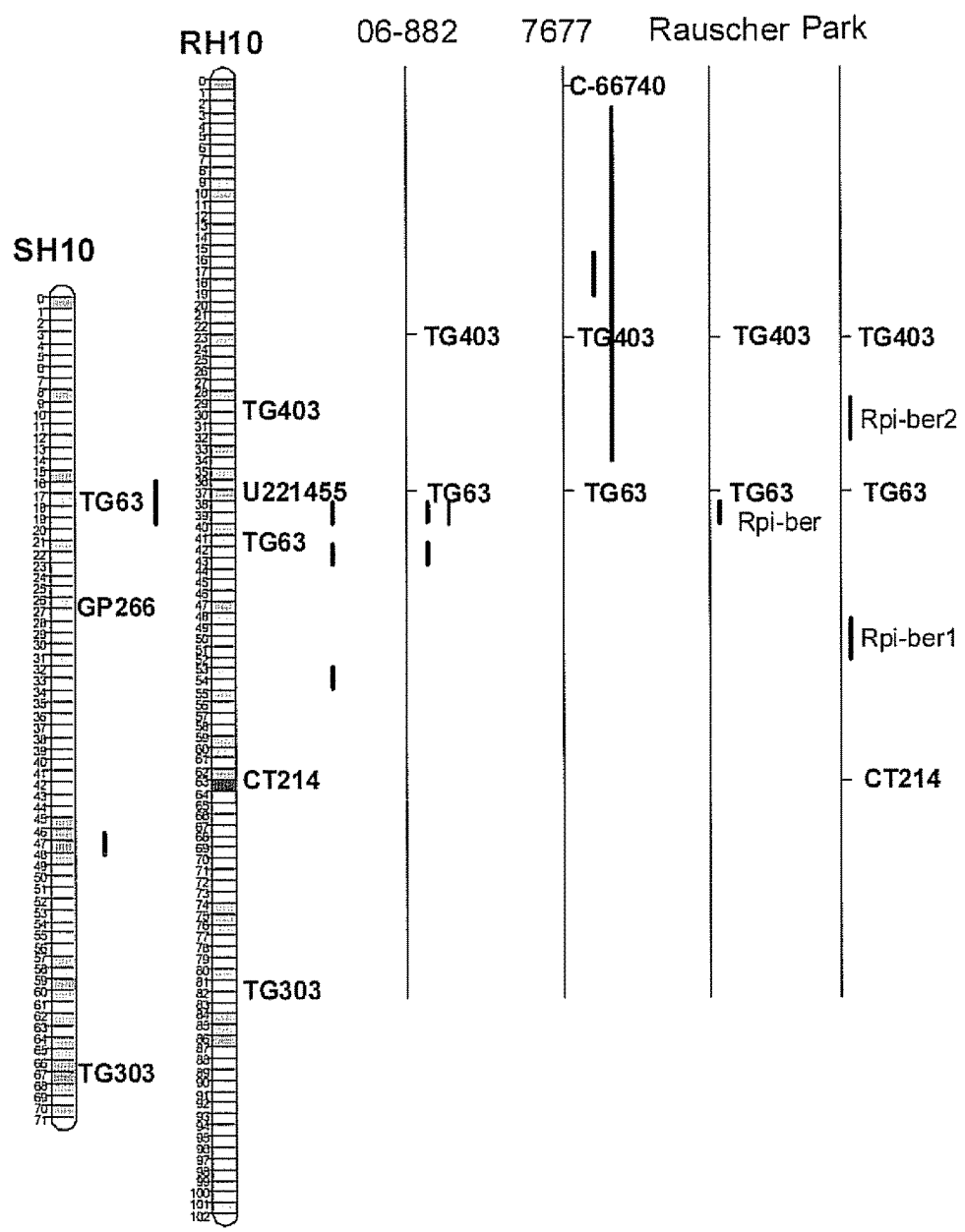

FIG. 6. Map positions of Rpi-chc1 related sequences and late blight resistance genes on chromosome 10.

The UHD maps of the SH and RH chromosomes are shown on left (van Os et al., 2006). 06-882 and 7677, as produced in this study, are shown in the middle. The positions of Rpi-ber (Rauscher et al., 2006), Rpi-ber1 and Rpi-ber2 (Park et al., 2008) are shown on the right. Red lines indicate the location of Rpi-chc1 related sequences. Green lines indicate the location of late blight resistance genes.

FIG. 7A-B. Nucleotide sequence of clone CHC B2-3 (7907 bp) (SEQ ID NO:125) containing the Rpi-chc1 coding- and regulatory sequences. The Rpi-chc1 coding region of 4550 bp is highlighted by shading (3358-7266). The upstream 3357 nucleotides (1-3357) and the downstream 641 nucleotides (7267-7907) harbour the regulatory sequences.

Figure 8:
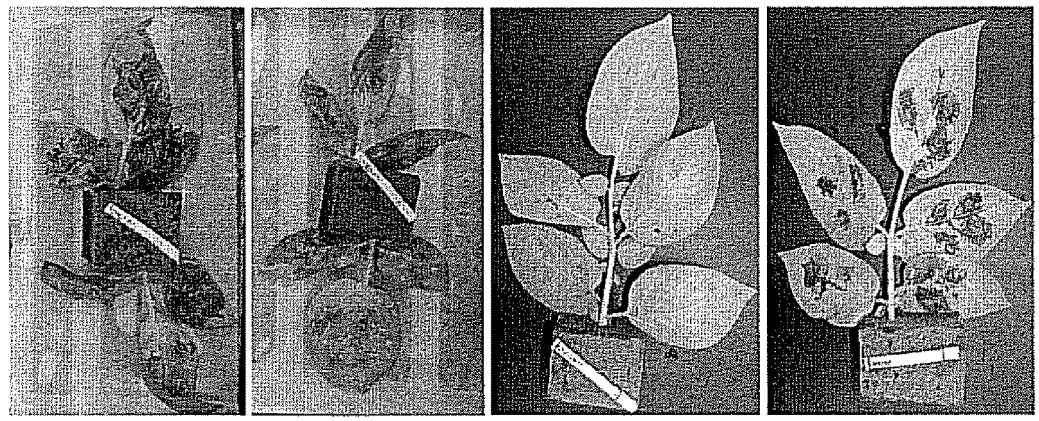

FIG. 8. Functional complementation of *Phytophthora infestans* (Pi) susceptibility in transgenic Desiree plants. Cv Desiree transformed with Rpi-chc1 candidate genes (RGC-1, -2 and -3) were challenged with Pi isolate 90128 in a detached leaf assay. Pictures were taken 6 days post inoculation. Only in transgenics containing RGC-3 resistance was observed.

Figure 9:
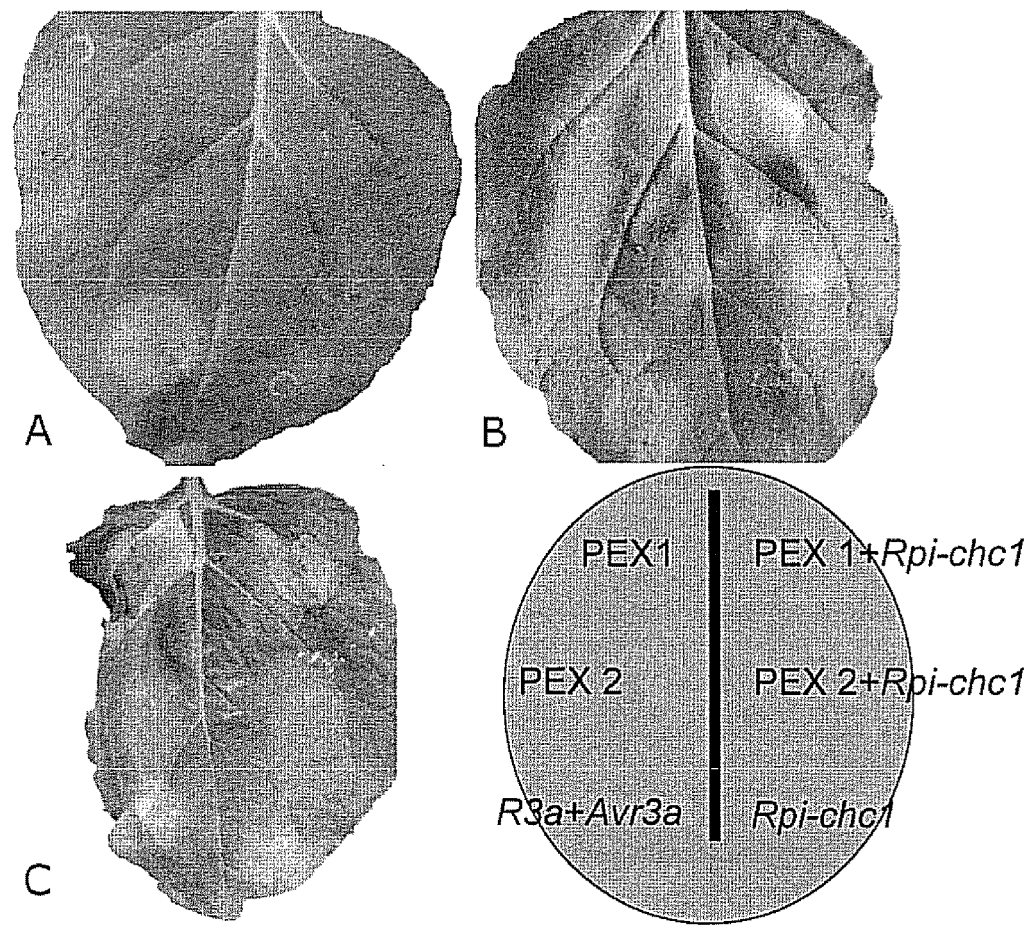

FIG. 9. Screening of PEX set using co-infiltration. PEX clones were infiltrated in the leafs of *N. benthamiana* alone or co-infiltrated with Rpi-chc1. One week after infiltration pictures were taken. Leaf A, PEX1=RD31, PEX2=RD36. Leaf B PEX1=RD12-1, PEX2=RD12-2. Leaf C PEX1=INF1, PEX2=pGR106. In each leaf the bottom left spot was infiltrated with R3a+avr3a. The bottom right spots were infiltrated with Rpi-chc1. Leaf A shows no identification of a responding effector. B shows necrosis for the interaction of Rpi-chc1 and RD 12. C shows autonecrosis for INF1.

FIG. 10. Regulatory elements driving Rpi-chc1 expression.

The Rpi-chc1 ORF was cloned in between one of four promoter/terminator sequences; its own 3 kb promotor and 0.5 kb terminator (p-chc1-long), 0.9 kb of its own promoter and 0.5 kb terminator (p-chc1-short), the double 35S promoter in pMDC32 or the Rpi-blb3 promotor/terminator combination (Lokossou et al., 2009). Co-agro-infiltration with PEX-RD12 was performed at five serial dilutions (OD600=2.0, 1.0, 0.5, 0.2, 0.1), as indicated. R3a mixed with Avr3a was used as positive control (+) and Rpi-chc1 was used as a negative control (−). Pictures were taken 6 days post infiltration.

FIG. 11. Selection of Rpi-chc1 specific primer pairs, used for germplasm screening.

A. Selection of Rpi-chc1 specific primer pairs. Primer combinations a: 581+582, b: 585+587, c: 585+589, d: 586+587, e: 586+589, f: 588+589 refer to Table 8. Templates used were 1: chc543-5 (donor plant for Rpi-chc1), 2: chc544-5 (susceptible parent of mapping population, 3: RH89-39-16 (susceptible plant, donor of Rpi-chc1 homologous sequences, 4: CHC BAC-1 (BAC clone containing three inactive RGA's), 5: CHC BAC-2 (BAC clone containing Rpi-chc1), 6: MQ.

B. 225 genotypes from taxonomic groups 10-12 till 10-17, listed in Table 7 were screened with primer combination D. White arrowheads indicate the fragments of the expected size in 6 genotypes.

FIG. 12. Fylogenetic analysis of Rpi-chc1 homologs. green: Sequences isolated by Rpi-chc1 homolog PCR (Example 2) black: Rpi-chc1 homologs identified during map based cloning (Example 1)

FIG. 13A-T. Nucleic acid sequences of 22 mined Rpi-chc1 homologs (SEQ ID NOS:181, 183, 185, 187, 189, 191, 193, 195, 197, 199, 202, 204, 206, 208, 210, 212, 214, 216, 218, 220, 222, and 224, in order of appearance).

FIG. 14A-AQ. Clustal W alignment of protein sequences encoded by Rpi-chc1 homologs of FIG. 11 and Rpi-chc1 homologous sequences described in Example 1 (SEQ ID NOS:205, 209, 188, 203, 186, 190, 225, 182, 219, 192, 223, 217, 184, 194, 207, 221, 198, 211, 213, 200-201, 196, and 215, in order of appearance).

DETAILED DESCRIPTION

As used herein, the term "plant or part thereof" means any complete or partial plant, single cells and cell tissues such as plant cells that are intact in plants, cell clumps and tissue cultures from which potato plants can be regenerated. Examples of plant parts include, but are not limited to, single cells and tissues from pollen, ovules, leaves, embryos, roots, root tips, anthers, flowers, fruits, stems shoots, tubers, including potato tubers for consumption or 'seed tubers' for cultivation or clonal propagation, and seeds; as well as pollen, ovules, leaves, embryos, roots, root tips, anthers, flowers, fruits, stems, shoots, scions, rootstocks, seeds, protoplasts, calli, and the like.

As used herein, the term "population" means a genetically heterogeneous collection of plants sharing a common genetic derivation.

As used herein, the term "variety" is as defined in the UPOV treaty and refers to any plant grouping within a single botanical taxon of the lowest known rank, which grouping can be: (a) defined by the expression of the characteristics that results from a given genotype or combination of genotypes, (b) distinguished from any other plant grouping by the expression of at least one of the said characteristics, and (c) considered as a unit with regard to its suitability for being propagated unchanged.

The term "cultivar" (for cultivated variety) as used herein is defined as a variety that is not normally found in nature but that has been cultivated by humans, i.e. having a biological status other than a "wild" status, which "wild" status indicates the original non-cultivated, or natural state of a plant or accession. The term "cultivar"specifically relates to a potatoplant having a ploidy level that is tetraploid. The term "cultivar" further includes, but is not limited to, semi-natural, semi-wild, weedy, traditional cultivar, landrace, breeding material, research material, breeder's line, synthetic population, hybrid, founder stock/base population, inbred line (parent of hybrid cultivar), segregating population, mutant/genetic stock, and advanced/improved cultivar.

As used herein, "crossing" means the fertilization of female plants (or gametes) by male plants (or gametes). The term "gamete" refers to the haploid or diploid reproductive cell (egg or sperm) produced in plants by meiosis, or by first or second restitution, or double reduction from a gametophyte and involved in sexual reproduction, during which two gametes of opposite sex fuse to form a diploid or polyploid zygote. The term generally includes reference to a pollen (including the sperm cell) and an ovule (including the ovum). "Crossing" therefore generally refers to the fertilization of ovules of one individual with pollen from another individual, whereas "selfing" refers to the fertilization of ovules of an individual with pollen from genetically the same individual.

The term "backcrossing" as used herein means the process wherein the plant resulting from a cross between two parental lines is crossed with one of its parental lines, wherein the parental line used in the backcross is referred to as the recurrent parent. Repeated backcrossing results in the genome becoming more and more similar to the recurrent parent, as far as this can be achieved given the level of homo- or heterozygosity of said parent.

As used herein, "selfing" is defined as refers to the process of self-fertilization wherein an individual is pollinated or fertilized with its own pollen.

The term "marker" as used herein means any indicator that is used in methods for inferring differences in characteristics of genomic sequences. Examples of such indicators are restriction fragment length polymorphism (RFLP) markers, amplified fragment length polymorphism (AFLP) markers, single nucleotide polymorphisms (SNPs), insertion mutations, microsatellite markers (SSRs), sequence-characterized amplified regions (SCARs), cleaved amplified polymorphic sequence (CAPS) markers or isozyme markers or combinations of the markers described herein which defines a specific genetic and chromosomal location.

As used herein, "locus" is defined as the genetic or physical position that a given gene occupies on a chromosome of a plant.

The term "allele(s)" as used herein means any of one or more alternative forms of a gene, all of which alleles relate to the presence or absence of a particular phenotypic trait or characteristic in a plant. In a diploid cell or organism, the two alleles of a given gene occupy corresponding loci on a pair of homologous chromosomes. It is in some instance more accurate to refer to "haplotypes" (i.e. an allele of a chromosomal segment) in stead of "allele", however, in these instances, the term "allele" should be understood to comprise the term "haplotype".

The term "heterozygous" as used herein, and confined to diploids, means a genetic condition existing when different alleles reside at corresponding loci on homologous chromosomes.

As used herein, and confined to diploids, "homozygous" is defined as a genetic condition existing when identical alleles reside at corresponding loci on homologous chromosomes.

As used herein, and confined to tetraploids, the term "nulliplex", "simplex", "duplex", "triplex" and "quadruplex", is defined as a genetic condition existing when a specific allele at a corresponding locus on corresponding homologous chromosomes is present 0, 1, 2, 3 or 4 times, respectively. At the tetraploid level the phenotypic effect associated with a recessive allele is only observed when the allele is present in quadruplex condition, whereas the phenotypic effect associated with a dominant allele is already observed when the allele is present in a simplex or higher condition.

The terms "haploid", "diploid" and "tetraploid" as used herein are defined as having respectively one, two and four pairs of each chromosome in each cell (excluding reproductive cells).

The term "haplotype" as used herein means a combination of alleles at multiple loci that are transmitted together on the same chromosome. This includes haplotypes referring to as few as two loci, and haplotypes referring to an entire chromosome depending on the number of recombination events that have occurred between a given set of loci.

As used herein, the term "infer" or "inferring", when used in reference to assessing the presence of the fungal resistance as related to the expression of the Rpi-chc1 gene, means drawing a conclusion about the presence of said gene in a plant or part thereof using a process of analyzing individually or in combination nucleotide occurrence(s) of said gene in a nucleic acid sample of the plant or part thereof. As disclosed herein, the nucleotide occurrence(s) can be identified directly by examining the qualitative differences or quantitative differences in expression levels of nucleic acid molecules, or indirectly by examining (the expression level of) a the Rpi-chc1 protein.

The term "primer" as used herein refers to an oligonucleotide which is capable of annealing to the amplification target allowing a DNA polymerase to attach thereby serving as a point of initiation of DNA synthesis when placed under conditions in which synthesis of primer extension product which is complementary to a nucleic acid strand is induced, i.e., in the presence of nucleotides and an agent for polymerization such as DNA polymerase and at a suitable temperature and pH. The (amplification) primer is preferably single stranded for maximum efficiency in amplification. Preferably, the primer is an oligodeoxyribonucleotide. The primer must be sufficiently long to prime the synthesis of extension products in the presence of the agent for polymerization. The exact lengths of the primers will depend on many factors, including temperature and source of primer. A "pair of bi-directional primers" as used herein refers to one forward and one reverse primer as commonly used in the art of DNA amplification such as in PCR amplification.

As used herein, the term "probe" means a single-stranded oligonucleotide sequence that will recognize and form a hydrogen-bonded duplex with a complementary sequence in a target nucleic acid sequence analyte or its cDNA derivative.

The terms "stringency" or "stringent hybridization conditions" refer to hybridization conditions that affect the stability of hybrids, e.g., temperature, salt concentration, pH, formamide concentration and the like. These conditions are empirically optimised to maximize specific binding and minimize non-specific binding of primer or probe to its target nucleic acid sequence. The terms as used include reference to conditions under which a probe or primer will hybridise to its target sequence, to a detectably greater degree than other sequences (e.g. at least 2-fold over background). Stringent conditions are sequence dependent and will be different in different circumstances. Longer sequences hybridise specifically at higher temperatures. Generally, stringent conditions are selected to be about 5° C. lower than the thermal melting point (Tm) for the specific sequence at a defined ionic strength and pH. The Tm is the temperature (under defined ionic strength and pH) at which 50% of a complementary target sequence hybridises to a perfectly matched probe or primer.

Typically, stringent conditions will be those in which the salt concentration is less than about 1.0 M Na+ ion, typically about 0.01 to 1.0 M Na+ ion concentration (or other salts) at pH 7.0 to 8.3 and the temperature is at least about 30° C. for short probes or primers (e.g. 10 to 50 nucleotides) and at least about 60° C. for long probes or primers (e.g. greater than 50 nucleotides). Stringent conditions may also be achieved with the addition of destabilizing agents such as formamide. Exemplary low stringent conditions or "conditions of reduced stringency" include hybridization with a buffer solution of 30% formamide, 1 M NaCl, 1% SDS at 37° C. and a wash in 2×SSC at 40° C. Exemplary high stringency conditions include hybridization in 50% formamide, 1 M NaCl, 1% SDS at 37° C., and a wash in 0.1×SSC at 60° C. Hybridization procedures are well known in the art and are described in e.g. Ausubel, F. M., Brent, R., Kingston, R. E., Moore, D. D., Seidman, J. G., Smith, J. A., Struhl, K. eds. (1998) Current protocols in molecular biology. V. B. Chanda, series ed. New York: John Wiley & Sons.

The present invention describes the cloning of the Rpi-chc1 gene. Rpi-chc1 was mapped to a new R gene locus on chromosome 10 using a *S. chacoense* mapping population. Markers highly linked to Rpi-chc1 were used to generate a physical map of the R locus. Three R gene analogs (RGA) present on one of two BAC clones that encompassed the Rpi-chc1 locus were targeted for complementation analysis, one of which turned out to be the functional Rpi-chc1 gene. Outside the R-gene clusters described in this invention, Rpi-chc1 shares the highest amino acid sequence identity (40%) to a protein encoded by a gene with unknown function, designated ABF81421, from poplar (*Populus trichocarpa*). Lower percentages of homology (<30%) were found with R proteins previously identified within the Solanaceae (Table 3).

In a first embodiment, the invention provides an isolated or recombinant nucleic acid sequence comprising a nucleic acid sequence encoding the amino acid sequence Rpi-chc1 (=CHC_B2-3) as presented in FIG. 4A-K or a functional fragment or a functional homologue thereof, i.e. a functional fragment or a functional homologue of the amino sequence as shown in FIG. 4A-K.

The term "nucleic acid" means a single or double stranded DNA or RNA molecule.

Also included are the complementary sequences of the herein described nucleotide sequences.

The term "functional fragment thereof" is typically used to refer to a fragment of the Rpi-chc1 protein that is capable of providing at least partial resistance or increasing resistance in a plant of the Solanaceae family against an oomycete infection. Such a fragment is, for example, a truncated version of the Rpi-chc1 protein as presented in FIG. 4A-K. A truncated version/fragment of the Rpi-chc1 protein is a fragment that is smaller than 1302 amino acids and preferably comprises part of the LRR domain (i.e. part of the leucine-rich repeats domain which stretches from about amino acid 557 to amino acid 1302 of Rpi-chc1) and/or the N-terminal parts of the Rpi-chc1 protein.

The term "functional homologue" is typically used to refer to a protein sequence that is highly homologous to or has a high identity with the herein described Rpi-chc1 protein, which protein is capable of providing at least partial resistance or increasing resistance in a plant of the *Solanaceae* family against an oomycete infection. Included are artificial changes or amino acid residue substitutions that at least partly maintain the effect of the Rpi-chc1 protein. For example, certain amino acid residues can conventionally be replaced by others of comparable nature, e.g. a basic residue by another basic residue, an acidic residue by another acidic residue, a hydrophobic residue by another hydrophobic residue, and so on. Examples of hydrophobic amino acids are valine, leucine and isoleucine. Phenylalanine, tyrosine and tryptophan are examples of amino acids with an aromatic side chain and cysteine as well as methionine are examples of amino acids with sulphur-containing side chains. Serine and threonine contain aliphatic hydroxyl groups and are considered to be hydrophilic. Aspartic acid and glutamic acid are examples of amino acids with an acidic side chain. In short, the term "functional homologue thereof" includes variants of the Rpi-chc1 protein in which amino acids have been inserted, replaced or deleted and which at least partly maintain the effect of the Rpi-chc1 protein (i.e. at least partly providing or increasing resistance in a plant of the Solanaceae family against an oomycete infection). Preferred variants are variants which only contain conventional amino acid replacements as described above. A high identity in the definition as mentioned above means an identity of at least 80, 85 or 90%. Even more preferred are amino acids that have an identity of 91, 92, 93, 94 or 95%. Most preferred are amino acids that have an identity of 96, 97, 98 or 99% with the amino acid sequence of Rpi-chc1. Homologous proteins are for example the sequences aligned with CHC_B2-3 in FIG. 5 and with the Rpi-chc1 ORF in FIG. 14A-AQ.

A functional homologous nucleic acid sequence is a nucleic acid sequence that encodes a functional homologous protein as described above.

Homology and/or identity percentages can for example be determined by using computer programs such as BLAST, ClustalW or ClustalX.

Many nucleic acid sequences code for a protein that is 100% identical to the Rpi-chc1 protein as presented in FIG. 4A-K. This is because nucleotides in a nucleotide triplet may vary without changing the corresponding amino acid (wobble in the nucleotide triplets). Thus, without having an effect on the amino acid sequence of a protein the nucleotide sequence coding for this protein can be varied. However, in a preferred embodiment, the invention provides an isolated or recombinant nucleic acid sequence as depicted in FIG. 7A-B. In a preferred embodiment, the invention provides an isolated, synthetic, or recombinant nucleic acid that represents the coding sequence (CDS) of the Rpi-chcl protein, i.e. nucleotides 3358-7266 of FIG. 7A-B (shaded) or a functional fragment or a functional homologue thereof. The nucleotide sequences of homologues with a high identity are represented in FIG. 13A-T, and the corresponding amino acid sequences are given in the alignment of FIG. 14A-AQ.

Fragments as well as homologues of the herein described Rpi-chc1 gene and protein can for example be tested for their functionality by using an *Agrobacterium tumefaciens* transient transformation assays (agro-infiltration) and/or by using a detached leaf assay.

The experimental part for example describes a functional screen for testing candidate genes using agro-infiltration, whereby 4 week old wild type *Nicotiana benthamiana* plants are infiltrated with *Agrobacterium* strains containing the candidate Rpi-chc1 homologues. The infiltrated leaves are subsequently challenged one day after infiltration with a *P. infestans* strain that is virulent on *N. benthamiana*, for example IPO-C or 90128, in detached leaf assays. This system is equally suitable for testing candidate homologous fragments of Rpi-chc1. A person skilled in the art thus can easily determine whether or not an Rpi-chc1 homolog or fragment can be considered to be a functional homolog or fragment.

Transient gene expression, as is achieved through agro-infiltration, is a fast, flexible and reproducible approach to high-level expression of useful proteins. In plants, recombinant strains of *Agrobacterium tumefaciens* can be used for transient expression of genes that have been inserted into the T-DNA region of the bacterial Ti plasmid. A bacterial culture is infiltrated into leaves, and upon T-DNA transfer, there is ectopic expression of the gene of interest in the plant cells. However, the utility of the system is limited because the ectopic RNA expression ceases after 2-3 days. It is shown that post-transcriptional gene silencing (PTGS) is a major cause for this lack of efficiency. A system based on co-expression of a viral-encoded suppressor of gene silencing, the p19 protein of tomato bushy stunt virus (TBSV), prevents the onset of PTGS in the infiltrated tissues and allows high level of transient expression. Expression of a range of proteins was enhanced 50-fold or more in the presence of p19 so that protein purification could be achieved from as little as 100 mg of infiltrated leaf material. Although it is clear that the use of p19 has advantages, an agroinfiltration without p19 can also be used to test the functionality of candidate fragments and functional homologues.

Alternatively, each candidate gene (for example being a fragment or homologue) construct is targeted for transformation to a susceptible potato cultivar, for example Desiree. Primary transformants are challenged in detached leaf assays using for example isolates IPO-0, IPO-C or 90128. Transformants that are resistant to these isolates harbour for example functional fragments or homologues of Rpi-chc1.

In yet another embodiment, the invention provides a vector comprising a nucleic acid as provided herein, i.e. a nucleic acid capable of providing at least partial resistance or increasing resistance in a plant of the Solanaceae family against an oomycete infection. More particularly, the invention provides a vector comprising an isolated, synthetic or recombinant nucleic acid sequence comprising a nucleic acid sequence encoding the amino acid sequence Rpi-chc1 of FIG. 4A-K or a functional fragment or a functional homologue thereof. The invention also provides a vector comprising a nucleic acid sequence as depicted in FIG. 7A-B.

Examples of a suitable vector are pBeloBACII, pBINplus, pKGW-MG or any commercially available cloning vector.

As will be outlined below there are multiple ways in which a nucleic acid of the invention can be transferred to a plant. One suitable means of transfer is mediated by Agrobacterium in which the nucleic acid to be transferred is part of a binary vector and hence it is preferred that the above described vector is a binary vector. Another suitable means is by crossing a plant which contains the gene encoding Rpi-chc1 to a plant that does not contain the gene and to identify those progeny of the cross that have inherited the Rpi-chc1 gene.

The invention further provides a host cell comprising a nucleic acid as described herein or a vector as described herein. Examples of a preferred host cell are an *E. coli* cell suitable for BAC clones (e.g. DH10B) or an *Agrobacterium* (host) cell. In another embodiment, said host cell comprises a plant cell. A preferred plant cell is a cell derived from a member of the Solanaceae family and even more preferred said plant cell comprises a cell from *Solanum tuberosum*, *Solanum lycopersicum*, formerly known as *Lycopersicon esculentum*, pepper and eggplant. From such a cell, a transgenic or genetically modified plant (for example a potato or tomato plant) can be obtained by methods known by the skilled person (for example regeneration protocols).

The invention further provides a leaf, tuber, fruit or seed or part or progeny of a genetically modified plant as described herein.

In yet another embodiment, the invention provides a protein encoded by the herein described isolated or recombinant nucleic acid or a functional fragment or a functional homologue thereof. In a preferred embodiment, the invention provides a protein encoded by a nucleic acid sequence as depicted in FIG. 7A-B. In yet another preferred embodiment, the invention provides a protein comprising the amino acid sequence of FIG. 4A-K or a functional fragment or a functional homologue thereof. Further preferred are the functional (active) proteins depicted in FIG. 14A-AQ, more specifically the proteins designated as 493-7_G12, 543-5_C2, 849-1_M8_M18_M20, 487-1_I4_I6_I8, 94-2031_L4_L7_18, 561-2_K4_K14_K22, 324-2_J1_J3_J8, 852-5_E14_E23, 852-5_E28, 493-9_H5_H30, 493-7_G14_G22, 561-2_K6_K30_K31 and 493-7_G21.

The herein described Rpi-chc1 protein comprises 1302 amino acids and the LRR domains of Rpi-chc1 consist of 29 imperfect repeats (FIG. 5). Interestingly Rpi-chc1 shares the highest homology (75-98%) with other RGAs from the Rpi-chc1 gene cluster from *S. chacoense* and with genes from synthenic clusters on chromosome 10 from *S. tuberosum* (Table 3). A lower (40%), but significant, extent of homology was found with a protein encoded by a gene with unknown function from poplar (accession number ABF81421, Table 3). The different domains of Rpi-chc1 share varying degrees of homology with corresponding domains of the poplar protein encoded by ABF81421. The NBS domain is most conserved (48% aa identity), followed by the CC domain (34% aa identity). The LRR domain is least conserved (21% aa identity). Overall homologies of lower than 33% are found with the FOM2 protein from cucumber, which confers resistance to fungal pathogen *Fusarium oxysporum*, Rpi-blb1 from *S. bulbocastanum*, R3a from *S. demissum*, and RPS1 from soybean (*Glycine max*), which confer resistance to *Phytophthora* sp. These sequence homologies show that Rpi-chc1 is a member of an ancient R-gene family that has not been characterised before in Solanaceae As already described, a functional fragment or a functional homologue thereof of Rpi-chc1 is a fragment or homologue that is capable of providing at least partial resistance or increasing resistance in a plant of the Solanaceae family against an oomycete infection.

Means to test the functionality of a functional fragment or a functional homologue of Rpi-chc1 have been provided above.

Based on the herein described nucleic acid sequences, the invention also provides probes and primers (i.e. oligonucleotide sequences complementary to one of the (complementary) DNA strands as described herein). Probes are for example useful in Southern or northern analysis and primers are for example useful in PCR analysis. Primers based on the herein described nucleic acid sequences are very useful to assist plant breeders active in the field of classical breeding and/or breeding by genetic modification of the nucleic acid content of a plant (preferably said plant is a *Solanum tuberosum*, *Solanum lycopersicum*, formerly known as *Lycopersicon esculentum*), pepper or eggplant in selecting a plant that is capable of expressing for example Rpi-chc1 or a functional fragment or functional homolog thereof.

Hence, in a further embodiment, the invention provides a binding molecule capable of binding to a nucleic acid encoding Rpi-chc1 or a functional fragment or functional homolog thereof as described herein or its complementary nucleic acid. In a preferred embodiment, said binding molecule is a primer or a probe. As mentioned, such a binding molecule is very useful for plant breeders and hence the invention further provides a method for selecting a plant or plant material or progeny thereof for its susceptibility or resistance to an oomycete infection. Preferably, the nucleic acid of a plant to be tested is isolated from said plant and the obtained isolated nucleic acid is brought in contact with one or multiple (preferably different) binding molecule(s). One can for example use a PCR analysis to test plants for the presence of absence of Rpi-chc1 in the plant genome. Such a method would be especially preferable in marker-free transformation protocols, such as described in WO 03/010319.

The herein described Rpi-chc1 protein can also be used to elicit antibodies by means known to the skilled person. The invention thus also provides an antibody that (specifically) binds to the protein encoded by the herein described isolated or recombinant nucleic acid (for example the nucleic acid sequence of FIG. 7A-B) or an antibody that (specifically) binds to a protein as depicted in FIG. 4A-K or a functional fragment or a functional homolog thereof. Such an antibody is for example useful in protein analysis methods such as Western blotting or ELISA, and hence can be used in selecting plants that successfully express the Rpi-chc1 gene.

Based on the herein provided nucleic acid sequences, the invention also provides the means to introduce or increase resistance against an oomycete infection in a plant. The invention therefore also provides a method for providing at least partial resistance or increasing resistance in a plant against an oomycete infection comprising providing a plant or a part thereof with:

an isolated or recombinant nucleic acid sequence comprising a nucleic acid sequence encoding the Rpi-chc1 amino acid sequence of FIG. 4A-K or a functional fragment or a functional homologue thereof, or an isolated or recombinant nucleic acid sequence as depicted in FIG. 7A-B, or a vector comprising the herein described nucleic acid sequences, or a host cell as described herein.

Such a method for providing at least partial resistance or increasing resistance in a plant against an oomycete infection may be based on classical breeding, departing from a parent plant that already contains the Rpl-chc1 gene or a functional homolog thereof, or it involves the transfer of DNA into a plant, i.e., involves a method for transforming a plant cell comprising providing said plant cell with a nucleic acid as described herein or a vector as described herein or a host cell as described herein.

There are multiple ways in which a recombinant nucleic acid can be transferred to a plant cell, for example *Agrobacterium* mediated transformation. However, besides by *Agrobacterium* infection, there are other means to effectively deliver DNA to recipient plant cells when one wishes to practice the invention. Suitable methods for delivering DNA to plant cells are believed to include virtually any method by which DNA can be introduced into a cell, such as by direct delivery of DNA such as by PEG-mediated transformation of protoplasts, by desiccation/inhibition-mediated DNA uptake (Potrykus et al., Mol. Gen. Genet., 199:183-188, 1985), by electroporation (U.S. Pat. No. 5,384,253), by agitation with silicon carbide fibers (Kaeppler et al., 1990; U.S. Pat. No. 5,302,523; and U.S. Pat. No. 5,464,765), and by acceleration of DNA coated particles (U.S. Pat. Nos. 5,550,318; 5,538,877; and 5,538,880). Through the application of techniques such as these, cells from virtually any plant species may be stably transformed, and these cells may be developed into transgenic plants.

In case *Agrobacterium* mediated transfer is used, it is preferred to use a substantially virulent *Agrobacterium* such as *A. tumefaciens*, as exemplified by strain A281 or a strain derived thereof or another virulent strain available in the art. These *Agrobacterium* strains carry a DNA region originating from the virulence region of the Ti plasmid pTiBo542, which coordinates the processing of the T-DNA and its transfer into plant cells. *Agrobacterium*-based plant transformation is well known in the art (as e.g. described in, for example by Komari, T. et al.: Plant Transformation Technology: *Agrobacterium*-Mediated Transformation, in: Handbook of Plant Biotechnology, Eds. Christou, P. and Klee, H., John Wiley & Sons, Ltd, Chichester, UK 2004, pp. 233-262). Preferably a marker-free transformation protocol is used, such as described in WO 03/010319.

Alternatively, the nucleic acid of the Rpi-chc1 gene or a functional homolog thereof may be introduced into a plant by crossing. Such a crossing scheme starts off with the selection of a suitable parent plant. This may for instance be an original *Solanum chacoense* variety (such as accession CHC543-5), an original *S. tarijense* variety (such as accession TAR852-5), an original *S. sucrense* variety (such as accession SUC849-2) or an original *S. berthaultii* variety (such as accession BER481-3 or BER94-2031) or a plant that has obtained the desired nucleic acid by genetic engineering as described above.

Any suitable method known in the art for crossing selected plants may be applied in the method according to the invention. This includes both in vivo and in vitro methods. A person skilled in the art will appreciate that in vitro techniques such as protoplast fusion or embryo rescue may be applied when deemed suitable.

Selected plants that are used for crossing purposes in the methods according to the invention may have any type of ploidy. For example, selected plants may be haploid, diploid or tetraploid. However, crossing diploid plants, such as *S. chacoense*, *S. tarijense* and *S. berthaultii*, will only provide diploid offspring. Crossing a diploid plant with a tetraploid plant will result in triploid offspring that is sterile.

Thus, when plants are selected that are diploid, their ploidy must be increased to tetraploid level before they can be crossed with another tetraploid plant in the methods according to the invention. Methods for increasing the ploidy of a plant are well known in the art and can be readily applied by a person skilled in the art. For example, ploidy of a diploid plant for crossing purposes can be increased by using 2N gametes of said diploid plant. Ploidy can also be increased by inhibiting chromosome segregation during meiosis, for example by treating a diploid plant with colchicine. By applying such methods on a diploid plant, embryos or gametes are obtained that comprise double the usual number of chromosomes. Such embryos or gametes can then be used for crossing purposes. For potatoes a resistant tetraploid plant is preferred, since tetraploid plants are known to have higher yields of tubers.

Since the resistance characteristic has appeared to be a dominant trait, it is sufficient if only one allele with the functional gene is present.

Preferably, selected plants are crossed with each other using classical in vivo crossing methods that comprise one or more crossing steps including selfing. By applying such classical crossing steps characteristics of both the parents can be combined in the progeny. For example, a plant that provides a high yield can be crossed with a plant that contains large amounts of a certain nutrient. Such a crossing would provide progeny comprising both characteristics, i.e. plants that not only comprise large amounts of the nutrient but also provide high yields.

When applying backcrossing, F1 progeny is crossed with one of its high-yielding parents P to ensure that the characteristics of the F2 progeny resemble those of the high-yielding parent. For example, a selected diploid potato with oomycete resistance is made tetraploid by using colchicine and then crossed with a selected high-yielding tetraploid potato cultivar, with the purpose of ultimately providing a high-yielding tetraploid progeny having oomycete resistance. Also selfing may be applied. Selected plants, either parent or progeny, are then crossed with themselves to produce inbred varieties for breeding. For example, selected specimens from the above mentioned F1 progeny are crossed with themselves to provide an F2 progeny from which specimens can be selected that have an increased level of resistance.

After transfer of a nucleic acid into a plant or plant cell, it must be determined which plants or plant cells have been provided with said nucleic acid. When selecting and crossing a parental genotype in a method according to the invention, a marker is used to assist selection in at least one selection step. It is known in the art that markers, indicative for a certain trait or condition, can be found in vivo and in vitro at different biological levels. For example, markers can be found at peptide level or at gene level. At gene level, a marker can be detected at RNA level or DNA level. Preferably, in the present invention the presence of such a marker is detected at DNA level, using the above described primers and/or probes. Alternatively, proper expression of the Rpi-chc1 protein or a functional homolog thereof can be assessed in plant parts by performing an immunoassay with an antibody that specifically binds the protein. Next to the primers and probes according to the invention, use can also be made of specific markers that are to be found in the vicinity of the coding sequence. Such markers are indicated in the experimental part below and comprise the markers as indicated in Table. 2. Markers are derived from accompanying BAC sequences.

In case of transgenic approaches selecting a transformed plant may be accomplished by using a selectable marker or a reporter gene. Among the selective markers or selection genes that are most widely used in plant transformation are the bacterial neomycin phosphotransferase genes (nptI, nptII and nptIII genes) conferring resistance to the selective agent kanamycin, suggested in EP131623 and the bacterial aphlV gene suggested in EP186425 conferring resistance to hygromycin. EP 275957 discloses the use of an acetyl transferase gene from *Streptomyces viridochromogenes* that confers resistance to the herbicide phosphinotricin. Plant genes conferring relative resistance to the herbicide glyphosate are suggested in EP218571. Suitable examples of reporter genes are beta-glucuronidase (GUS), beta-galactosidase, luciferase and green fluorescent protein (GFP).

TABLE 2

Primer sequences (SEQ ID NOS: 1-103, in order of appearance from left to right) for amplification of specific (parts of) nucleotide sequences according to the invention.

| marker | Forward | F primer sequence 5'-3' | Reverse | R primer sequence 5'-3' | target(s) | polymorphism |
| --- | --- | --- | --- | --- | --- | --- |
| 2D06_3D21_C27-1 | MN469 | TGTTTGATCTCCTCACCCATC | MN470 | GTTCCCCTCCTCTCCCTCCC | 7650 | CAPS, enzyme Nla III |
| 2D06_3D21_C27-7 | MN491 | TGAGAATTTACAGTGGTTTGTTGC | MN492 | GATCAATCAATCGATCATAACGTC | 7650 | CAPS, enzyme RsaI |
| CHC_B07_1_C15_RP' | MN396 | CGACCCCACCCCCTCATCCTT | MN397 | CGCCAACATATTCGTGCTTCA | 7650 | CAPS, MnlI |
| CHC_B07_1_C15_T7 | MN382 | CGTGAGCTAAGCATGAACACC | MN383 | GCACGTTTCTCATAATCCCATC | 7650 | CAPS, enzyme HinfI |
| COS66740 | JV57 | ATGTGACTCCGCATTTGCAGCTC | JV58 | ATCTCATCTTATTAATCTGATTCAAAGC | 7650 | CAPS, enzyme FspBI |
| CT214 | JV117 | GAACGCGAAAGAGTGCTGATAG | JV118 | CCCGCTGCCTATGGAGAGT | 06-882 | CAPS, enzyme DdeI |
| RH036A10S | MN161 | GTGCATTACCCTGTTATTTTGC | MN162 | TGGGTCTTGGAAGACAGAGTG | 7650 | CAPS, enzyme DdeI |
| RH046C09T | MN257 | GGCCACGTATTAACAATTTTGAG | MN258 | GCATAGCAATTGAAAGCCTAAAC | 06-882 | CAPS, enzyme HpyCH4IV |
| RH070C16S | MN300 | TGTTTGACATCCTCCAGCAG | MN301 | CTCAGCTTGGGCTTTGTTTC | 06-882 | CAPS, enzyme AluI |
| RH077O23S | MN263 | ACATTAAAGGCTGCCCACAG | MN264 | GCAGTTGACAATTTTACGTC | 06-882 | CAPS, enzyme SduI |

TABLE 2-continued

| | | | | | | |
|---|---|---|---|---|---|---|
| RH092A09S | MN151 | TCAAGGTGGCATTCTTCAAC | MN152 | AAGCAAGGACTTTGCGATTC | 7650 | CAPS, enzyme NlaIII |
| RH097D21_C21-4 | MN406 | TTGCTTTGAGTTGTTGCCTG | MN407 | TATGCATCATCATCGCGAAC | 7650 | CAPS, enzyme HpyCH4IV |
| RH099F09T | MN292 | TGTTTGATGCTTGGGTAGTG | MN293 | CAGCGTTGAACACTCAAAATC | 7650 | CAPS, enzyme SsiI |
| RH106G03S | MN296 | TGGCCTAAAGTTGGCTGTTG | MN297 | TCCAACCAAAACATGAGACG | 06-882 | CAPS, enzyme Bsh1236I |
| RH106G03T | MN294 | CCCCGAATGATAAGTCCAAC | MN295 | TGAGGCATAGAGAACAATCTTTG | 7650 | CAPS, enzyme MseI |
| RH106G03T | MN294 | CCCCGAATGATAAGTCCAAC | MN295 | TGAGGCATAGAGAACAATCTTTG | 06-882 | CAPS, enzyme RsaI |
| RH137D14_C37-2 | JV233 | TTTCTTCTACTGTCTGGCTTGCTTGCGGGTAAC | JV234 | GAGTTGCTTTCTTGGACTTGCTTTCTTGACCT | 06-882, RH BAC(s) | CAPS, enzyme XapI |
| RH137D14_C37-7 | MN429 | AAAATTGCTGCCAAAGAAGC | MN430 | AGTCCGATACGCCAACCTAC | 7650 | CAPS, enzyme XapI |
| RH173M16T | MN165 | TCTTTGCTAGTCGTTGGTTGAG | MN166 | TGGGTTTCCCAAGTTGAAAG | 7650 | CAPS, enzyme Bme1390I |
| RH173M16T | MN165 | TCTTTGCTAGTCGTTGGTTGAG | MN166 | TGGGTTTCCCAAGTTGAAAG | 06-882 | CAPS, enzyme HpyF1oVI |
| RH198E12T | MA78 | GACTCTGCCGTGATTGCTGAA | MA79 | CACCGGGAAGACGCTGTTT | 06-882 | CAPS, enzyme RsaI |
| RH199E15S | MN177 | ACTTGGGAAACCCAGGAGAG | MN178 | TTTATGGTCCTCGGGTCTTGG | RHxSH | CAPS, enzyme Bme1390I |
| RH199E15S | MN177 | ACTTGGGAAACCCAGGAGAG | MN178 | TTTATGGTCCTCGGGTCTTGG | 06-882 | CAPS, enzyme HpyCH4IV |

TABLE 2-continued

| | | | | | | |
|---|---|---|---|---|---|---|
| RH199E15S | MN177 | ACTTGGGAAACCCAGAGAG | MN178 | TTTATGGTCCTGGGTCTTGG | 7650 | CAPS, enzyme MnlI |
| RH199E15T | MN173 | GATGCATATCATCAAATTCAATCTC | MN174 | CTCCGGTGTTATCGACGTG | 06-882 | CAPS, enzyme HinI II |
| RH199E15T | MN173 | GATGCATATCATCAAATTCAATCTC | MN174 | CTCCGGTGTTATCGACGTG | 7650 | CAPS, enzyme XapI |
| TG233 | JV95.2 | CATGGCTTTTTTCTTGGCATG | JV96 | TGGAACCCCTTTACTGTGC | 06-882 | CAPS, enzyme AluI |
| TG63 | JV23 | TCCAATTGCCAGACGAA | JV24 | TAGAGAAGGCCCTTGTAAGTTTT | 06-882 | CAPS, enzyme Bsh1236I |
| TG63 | JV23 | TCCAATTGCCAGACGAA | JV24 | TAGAGAAGGCCCTTGTAAGTTTT | 7650 | CAPS, enzyme HhaI |
| TG63 | JV80 | CTGCATCAACTGGATATTCC | JV81 | CTTGAGCCATGCAATGTAC | RHxSH | CAPS, enzyme SsiI |
| U221455 | JV82 | AGGGCTTTCTTTATTATCTTTGTC | JV83 | ACCACAAGCAATCAATTCTACACC | 7650 | CAPS, enzyme AluI |
| Rpi-chc1 locus directed profiling F1 | JV162 | ctaatycaactytgatggcwgaagg | adaptor | ACTTCGATTCTCAACCCGAAAG | SHxRH, 06-882 | MDP |
| Rpi-chc1 locus directed profiling F2 | JV163 | ctaccamkycgasaracagattcc | | ACTTCGATTTCTCAACCCGAAAG | SHxRH, 06-882 | MDP |
| Rpi-chc1 locus directed profiling R1 | JV164 | tggmckragaaamccttcwgccatc | | ACTTCGATTTCTCAACCCGAAAG | SHxRH, 06-882 | MDP |
| Rpi-chc1 locus directed profiling R2 | JV165 | ccwarrccwsccatwccyactat | | ACTTCGATTTCTCAACCCGAAAG | SHxRH, 06-882 | MDP |
| RH099F09S | MN290 | CATGAGAAATGAACCCCTCAC | MN291 | AACGTGCAGAGGTATTTTGG | 7650 | SCAR |
| RH134D08S | MN286 | TTTTCCACAGAATAGCCAAGAC | MN287 | ATCTGGGCTCATCCGAATC | 06-882 | SCAR |
| RH056H18S | MN320 | GGCCATTGTTTGTGAAACTG | MN321 | CGTCGGGAAGTTCACATTGC | 7650 | SCAR |
| RH40G17T | MN251 | TAGGGGTGTCAAATGAGC | MN252 | GCTGGAACTTCACAGTAAAACC | 7650 | SCAR |
| RH40G17T | MN251 | TAGGGGTGTCAAATGAGC | MN252 | GCTGGAACTTCACAGTAAAACC | 06-882 | SCAR |
| RH199E15T | MN173 | GATGCATATCATCAAATTCAATCTC | MN174 | CTCCGGTGTTATCGACGTG | RHxSH | SCAR |
| RH092A09S | MN151 | TCAAGGTGGCATTCTTCAAC | MN152 | AAGCAAGGACTTTGCGATTC | RHxSH | SCAR |
| E39/M56_GW fragment | MN113 | CTAAGGGTTCCTCCGAAG | MN114 | CAAATTGGACCGAACCTTTG | 7650 | SCAR |
| RH091C10T | MN304 | CCCGAGATCCAGTGAAATTG | MN305 | GGTTCTGAACTCATCCTATTCCTC | 06-882 | SCAR |
| RH046C09S | MN253 | TAGGGGGTGTCAAATGAGC | MN254 | ATGCAAAACGGAGTTAGGG | 06-882 | SCAR |
| RH047F10S | MA92 | TTGTGTACATTTCTATCCCCCG | MA93 | TGGGCTATGCATCAATGG | 06-882 | SCAR |

TABLE 2-continued

| | | | | |
|---|---|---|---|---|
| RH106G03T | MN294 | CCCGAATGATAAGTCCAAC | MN295 | TGAGGCATAGAGAACAATCTTTG | 543-5 BAC(s) |
| CHC_B07_1_C15_T7 | MN382 | CGTGAGCTAAGCATGAACACC | MN383 | GCACGTTTCTCATAATCCCATC | RH BAC(s) |
| CHC_B07_1_C15_RP | MN396 | CGACCCCACCCCTCATCCTT | MN397 | CGCCAACATATTCGTGCTTCA | 543-5 BAC(s) |
| RH137D14_C37-7 | MN429 | AAAATTGCTGCCAAAGAAGC | MN430 | AGTCCGATACGCCAACCTAC | 543-5 BAC(s) |
| E46-M48c | MN38 | CGAACTCTGAGATTGGGACTATG | MN39 | CACGAATAGAACAATAATAGAAAAAG | RH BAC library |
| RH099F09S | MN290 | CATGAGAAATGAACCCCTCAC | MN291 | AACGTGCAGAGGTATTTTTGG | RH BAC(s) |
| RH134D08S | MN286 | TTTTCCACAGAATAGCCAAGAC | MN287 | ATCTGGGCTCATCCGAATC | RH BAC(s) |
| RH40G17T | MN251 | TAGGGGGTGTCAAAATGAGC | MN252 | GCTGGAACTTCACAGTAAAACC | RH BAC(s) |
| RH199E15T | MN173 | GATGCATATCATCAAATTCAATCTC | MN174 | CTCCGGTGTTATCGACGTG | RH BAC(s) |
| RH137D14T | MA74 | CTACAAATGATAAATAAGCAAACT | MA75 | AATAGGTGGAGGGAGGAC | RH BAC(s) |
| RH137D14S | MA72 | GAAGCAAACATCAATAATA | MA73 | TTCCCCTCAAATCATAG | RH BAC(s) |
| RH184J01T | MN288 | CCGATTTACTATTGGTTCATGC | MN289 | TCAAATTTCGATTGGCTTGC | RH BAC(s) |
| RH184J01T | MN288 | CCGATTTACTATTGGTTCATGC | MN289 | TCAAATTTCGATTGGCTTGC | 543-5 BAC(s) |
| RH070C16S | MN300 | TGTTTGACATCCTCCAGCAG | MN301 | CTCAGCTTGGGCTTTG TTTC | 543-5 BAC(s) |

In a preferred embodiment, the invention provides a method for providing at least partial resistance or increasing resistance in a plant against an oomycete infection comprising providing a plant or a part thereof with:

- an isolated or recombinant nucleic acid sequence comprising a nucleic acid sequence encoding the Rpi-chc1 amino acid sequence of FIG. 4A-K or a functional fragment or a functional homologue thereof, or
- an isolated or recombinant nucleic acid sequence as depicted in FIG. 7A-B, or an isolated or recombinant nucleic acid sequence encoding a protein selected from the group of 493-7_G12, 543-5_C2, 849-1_M8_M18_M20, 487-1_I4_I6_I8, 94-2031_L4_L7_18, 561-2_K4_K14_K22, 324-2_J1_J3_J8, 852-5_E14_E23, 852-5_E28, 493-9_H5_H30, 493-7_G14_G22, 561-2_K6_K30_K31 and 493-7_G21 as depicted in FIG. 13A-T,
- a vector comprising the herein described nucleic acid sequences, or
- a host cell as described herein, wherein said oomycete comprises Phytophthora, preferably Phytophthora infestans and/or wherein said plant comprises a plant from the Solanaceae family, preferably a potato or tomato plant, more preferably a tetraploid potato plant.

The invention also provides a plant that is obtainable by using a method for providing at least partial resistance or increasing resistance in a plant against an oomycete infection as described above. A preferred plant is a plant from the Solanaceae family and even more preferred said plant is a Solanum tuberosum or a Solanum lycopersicum, formerly known as Lycopersicon esculentum, Solanum melononga, Capsicum spp., such as C. annuum, C. baccatum, C. chinense, C. frutescens and C. pubescens. The invention thus also provides a plant that has been provided with a nucleic acid encoding a Rpi-chc1 protein or a functional fragment or a functional homologue thereof.

The invention further provides a plant part or progeny of a plant according to the invention comprising a nucleic acid encoding the Rpi-chc1 amino acid sequence of FIG. 4A-K or a functional fragment or a functional homologue thereof.

In a preferred embodiment, the herein described nucleic acid is transferred to a Solanum variety other than Solanum chacoense, i.e. the herein described nucleic acid is preferably provided to a non-chacoense background, preferably S. lycopersicon or S. tuberosum. Of the latter most preferred is a tetraploid variety and more preferably to a commercial interesting variety such as Bintje, Desiree or Premiere, Spunta, Nicola, Favorit, Russet Burbank, Aveka or Lady Rosetta.

It is also possible to provide the resistance according to the invention to a plant that is already partially resistant to an oomycete infection, wherein said plant is provided with a nucleic acid encoding a further resistance gene, such as Rpi-blb1,-2, -3, Rpi-vnt1 or Rpi-mcq1.

The invention further provides use of an isolated or recombinant nucleic acid sequence comprising a nucleic acid sequence encoding the Rpi-chc1 amino acid sequence of FIG. 4A-K or a functional fragment or a functional homologue thereof or use of an isolated or recombinant nucleic acid sequence as depicted in FIG. 7A-B or use of a vector comprising any of said nucleic acid sequences or use of a host cell comprising any of said nucleic acid sequences or said vector for providing a plant with at least partial resistance against an oomycete infection. In a preferred embodiment, said oomycete comprises Phytophthora and even more preferably Phytophthora infestans. In yet another preferred embodiment said plant comprises Solanum tuberosum or Solanum lycopersicum, formerly known as Lycopersicon esculentum.

In yet another embodiment, the invention provides a method for producing Rpi-chc1 protein or a functional fragment or a functional homologue thereof comprising functionally linking a nucleic acid as described herein to a regulatory sequence and allowing said nucleic acid to be expressed in a host cell. Examples of a regulatory sequence are a promoter and/or terminator sequence. Further, as will become clear from Example 2, it is preferred that the Rpi-chc1 sequence is expressed under control of its own promoter and terminator. Therefore, the invention further provides the promoter and/or terminator sequences of Rpi-chc1 (FIG. 7A-B). FIG. 7A-B show the nucleotide sequence of clone CHC B2-3 (7907 bp) containing the Rpi-chc1 gene and regulatory sequences. The Rpi-chc1 coding region of 4550 by is highlighted in shading (nt 3358-7266). The upstream 3357 nucleotides (nt 1-3357) and the downstream 641 nucleotides (nt 7267-7907) harbour the regulatory sequences that ensure correct expression of the gene. The skilled person is very well capable of cloning (part of) said regulatory sequences and testing their efficiency in transcription. It has further been found that even a better expression is obtained with a truncated promoter, i.e. a promoter containing less than 1000, preferably not more than 900 base pairs upstream of the gene sequence.

The invention will be explained in more detail in the following, non-limiting examples.

EXPERIMENTAL PART

Example 1

Population Development

A recent taxonomic regrouping of the Solanum section Petota revealed the lack of species structure in this section (Jacobs et al., 2008). In order to identify late blight resistance traits from the taxonomic group 10-14 (Jacobs et al., 2008) we selected several accessions and tested their resistance levels to Phytophthora infestans in field trials. Five accessions, that were previously determined as S. tarijense (TAR), S. berthaultii (BER), and S. chacoense (CHC), with high resistance levels were selected (TAR852-5, BER94-2031-01, BER481-3, BER493-7, CHC543-5). In order to study the genetic basis of these resistances, crosses were generated using BER493-7, CHC543-5, BER94-2031-01 as resistant parents. The resulting F1 populations were tested for the segregation of resistance to P. infestans in a detached leaf assay (Table 1).

TABLE 1 population analysis.

| pop number | R-parent | S-parent | Individuals | DLA R:S:Q | isolate |
|---|---|---|---|---|---|
| 06-882 | 94-2031-01 | G254 | 94 | 1:1:0 | IPO-C |
| 7677 | BER 493-7 | RH 89-039-16 | 71 | 3:3:1 | 90128 |
| 7650 | CHC 543-5 | CHC 544-5 | 212 | 1:1:0 | 90128 |

Detached leaf assays were performed in the offspring of the indicated crosses.
Segregation ratios of plants with R(esistant), S(usceptible) or Q(uestionable) phenotypes were determined.

In populations 7650 and 06-882 a clear 1:1 segregation was found, a hallmark for the segregation of a single dominant resistance gene. In population 7767 also a 1:1 segregation was found, however, also a group of 10 plants with intermediate (Q) resistance levels was found.

Map Positions of Rpi-chc1 and Rpi-ber

From literature it was known that a late blight resistance gene from *S. berthaultii* (Rpi-ber) was closely linked to TG63 on the long arm of chromosome 10 (Rauscher et al., 2006), a region to which also the tomato Ph-2 QTL from *S. pimpenellifolium* mapped (Moreau et al., 1998). We therefore developed CAPS markers in TG63 in the three populations. Using the polymorphism described in Table 2, it was found that the resistances in 06-882 and 7650 were closely linked to TG63 since one and two recombinants were found respectively. Also the resistance in 7677 was linked to TG63 albeit a higher recombination frequency (15 recombinations) was observed. It is concluded that this area on chromosome 10 is very important for resistance to late blight. Therefore, we set out to exploit the well characterised RH89-039-16 physical map in order to generate a reference map of the TG63 locus. Using the polymorphism described in Table 2, TG63 was mapped to RH10B41. At this map position the contig 6701 was anchored. BAC end sequences in this contig were used to generate markers suitable for mapping in population 7650. RH199E15S (Table 2) was found to co-segregate with resistance in 7650 and 06-882, indicating that 6710 from RH89-039-16 was in a locus synthenic with the Rpi-chc1 and Rpi ber locus.

Besides anchoring TG63 genetically, it was also located in the physical map of RH89-039-16 by PCR screening the RH BAC library. A positive contig, 2203, was found. Remarkably, contig 2203 was anchored to RH10B38 using two independent markers (Jan de Boer, PGSC). CAPS markers were developed based on BAC end sequences in contig 2203 and mapped in the 06-882 and 7650 populations. Also these markers were closely linked to resistance, indicating that also this contig is in a locus synthenic with the Rpi-chc1 and Rpi-ber locus.

Using BAC-end sequences, three additional RH BAC contigs flanking contigs 2203 and 6701 were identified (FIG. 1A). In order to generate sufficient sequence information for finemapping two tiling paths consisting of 3 and 4 overlapping BACs (106G038, 137D014, 009D021 and 122B15, 77O23, 04G12, 199E15) were composed and sequenced. Annotation of the RH BAC sequence (FIG. 2) revealed the presence of two RGAs in the first tiling path (that mapped to RH10B38) and 7 RGAs in the second tiling path (that mapped to RH10B41, 42), indicated as arrowheads in FIG. 1A. Several markers deriving from these and other chromosome 10 sequences were mapped in the *S. chacoense* population 7650 (FIG. 1B) and in the *S. berthaultii* population 06-882 (FIG. 1A). The sizes of these populations were increased to 2357 and 2532 respectively. Recombinants in the relevant genomic area were screened for using markers RH099F09T and RH092A09S in population 7650 en markers RH91C10T and RH199 E15 S in population 06-882. Markers that were derived from the same RH BAC (RH137D14), 137D14-C37-7 and 137D14-C37-2 are only 15 kb apart in RH89-039-16 and co-segregate in the 7650 population (two recombinants) and in the 06-882 population (no recombinants), respectively. This strongly suggests that Rpi-chc1 and Rpi-ber are in synthenic gene clusters and that there might be an allelic relationship between the genes.

Cloning of Rpi-chc1

Figure 1B:
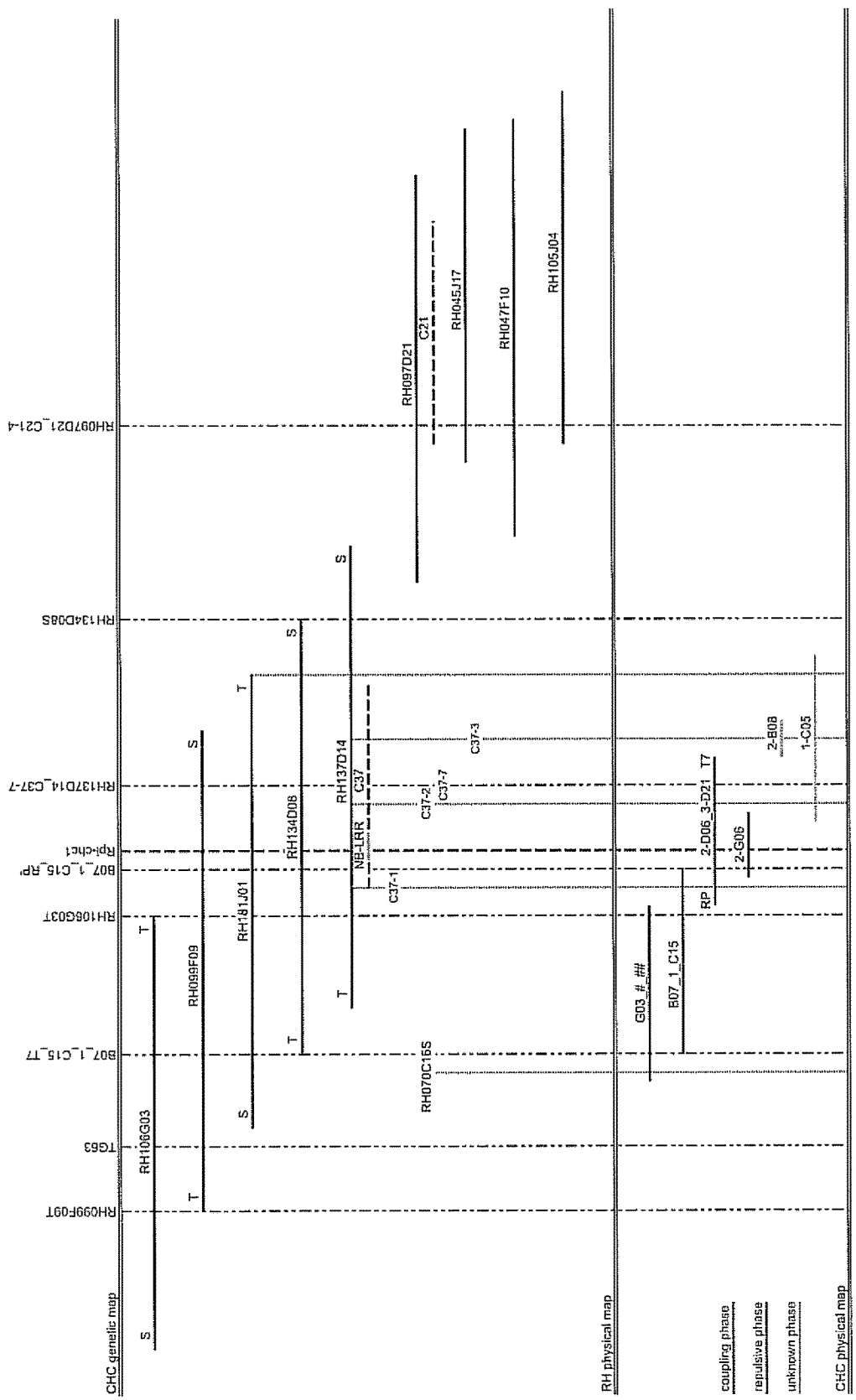
Figure 4I:
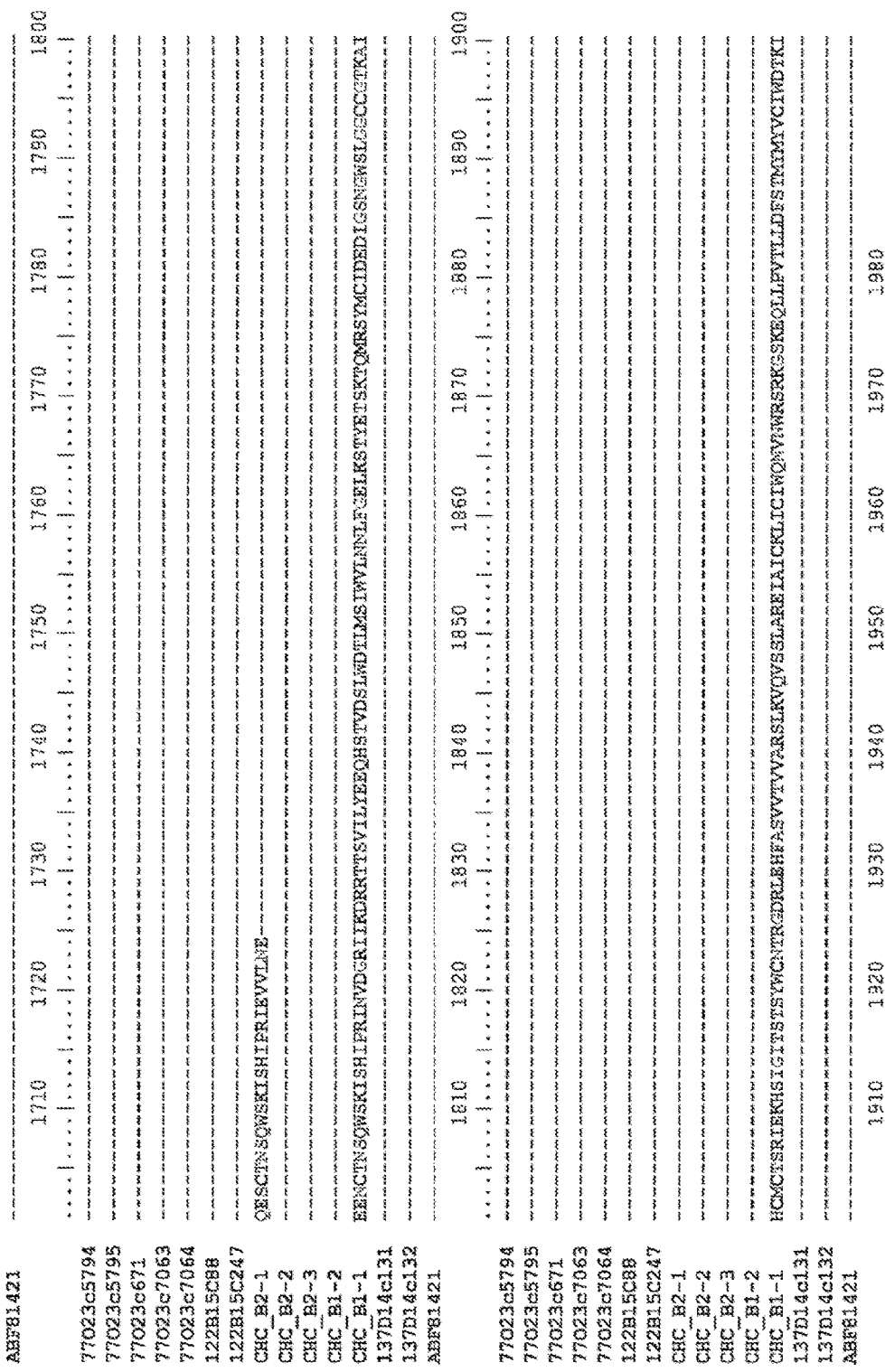

In order to clone Rpi-chc1, two BAC libraries were constructed using DNA derived from the resistant clone CHC543-5. The first library was constructed in the pCC1BAC BAC vector and contained approximately 22.000 clones with an average insert size of ~70 Kbp, corresponding to 1 genome equivalent. A second library was constructed in the pIndigoBAC-5 BAC vector and contained approximately 110.000 clones with an average insert size of ~45 Kbp, corresponding to 3 genome equivalents. The first library was screened with marker RH106G03T (Table 2, FIG. 1B), which cosegregated with resistance in the 7650 population with only three recombination events. In this way BAC clones CHC B1 was identified. Both BAC ends of CHC B1 (B07_1_C15) were mapped and the RP end (marker B07_1_C15_RP'), which showed only one recombination event with the Rpi-chc1 resistance gene, was used to screen the second BAC library and identified CHC B2 (2-D06_3-D21) (FIG. 1B). CHC B2 turned out to contain the RH137D14 C37-7 marker. Two recombination events were found with RH137D14 C37-7, on the other site of the Rpi-chc1 resistance gene. It was therefore concluded that the Rpi-chc1 locus was delimited to a 0.2 cM (5/2357 recombinants) interval that is physically spanned by the two partially overlapping BAC clones CHC B1 and CHC B2 (FIG. 1B).

By sequencing these two BACs, it was found that CHC B1 contained two RGAs and CHC B2 contained three RGAs, which were named CHC B1-1, CHC B1-2, CHC B2-1, CHC B2-2, and CHC B2-3 respectively (FIG. 2). The latter three RGAs were within mapping interval delimited by B07_1_C15_RP' and RH137D14 C37-7. Therefore, the three genes were subcloned into pBINplus vector under the control of their native regulatory elements by long-range PCR using the high fidelity polymerase Phusion®. The resulting subclones were completely sequenced and were found to be identical to their BAC template sequences.

Complementation analysis was carried out in *Nicotiana benthamiana* using the *Agrobacterium tumefaciens* transient assay (agroinfiltration) whereby 4-week old wild type *N. benthamiana* plants were infiltrated with the *Agrobacterium* strain AGL1+virG containing pBINplus:CHC B2-1, pBINplus:CHC B2-2, and pBINplus:CHC B2-3 respectively. As controls we used pBINplus without an insert and pBINplus:Rpi-blb1. Infiltrated leaves were challenged after two days with *P. infestans* strain 90128 in detached leaf assays (DLA). Leaves infiltrated with pBINplus:CHC B2-3 and pBINplus:Rpi-blb1 showed resistance to infection, while pBINplus:CHC B2-1, pBINplus:CHC B2-2 and pBINplus without an insert were colonized by *Phytophtora* as was apparent from the sporulating lesions (FIG. 3). This experiment clearly showed that CHC B2-3 is an active resistance gene against *P. infestans*. Since none of the other genes present in the genetic mapping interval of Rpi-chc1 shows activity, it can be concluded that CHC B2-3 is the Rpi-chc1 gene.

Rpi-chc1 Homology and Structure

Interestingly, Rpi-chc1 shares the highest homology (75-98%) with other RGAs from the Rpi-chc1 gene cluster from *S. chacoense* and with genes from synthenic clusters on chromosome 10 from *S. tuberosum* clone RH89-039-16 (Table 3, FIG. 4A-K). A lower (40%), but significant, extent of homology was found with a protein encoded by a gene with unknown function from poplar (accession number ABF81421, Table 3, FIG. 4A-K). The different domains of Rpi-chc1 protein share varying degrees of homology with corresponding domains of the poplar protein encoded by ABF81421. The NBS domain is most conserved (48% aa identity), followed by the CC domain (34% aa identity). The LRR domain is least conserved (21% aa identity). Overall homologies of lower than 33% are found with the FOM2 protein from cucumber (Joobeur et al., 2004), which confers resistance to fungal pathogen *Fusarium oxysporum*, Rpi-blb1 from *S. bulbocastanum* (Song et al., 2003; van der Vossen et al., 2003), R3a from *S. demissum* (Huang et al., 2005), and RPS1-k from soybean (*Glycine max*)(Gao et al., 2005), which confer resistance to *Phytophthora* sp.

Rpi-chc1 comprises an ORFs of 3909 nucleotides (nt) that encode a protein of 1302 amino acids harboring all sequences characteristic of a CC-NB-LRR R-proteins (FIG. 5). In the N terminus 5 stretches of amino acids can be distinguished with the potential to fold into a coiled coil structure. The central NB-ARC domain contains stretches of amino acids which show similarity with the Kinase 1a, Kinase 2, Kinase 3a, GLPL, RNBS-D and MHD subdomains (Bendahmane et al., 2002; van der Biezen and Jones, 1998). In contrast to many other NB-LRR proteins, the Rpi-chc1 protein is characterized by the absence of an obvious RNBS-A sub-domain and the presence of a double MHD sub-domain. The C-terminal domain contains 29 imperfect leucine rich repeats (LRRs). Both LRR 3 and 4 contain the characteristic LDL signature, which often present in LRR3. Both the MHD and the LRR3 have been implicated in activity regulation and putative intra-molecular interactions (Bendahmane et al., 2002; Tameling et al., 2006). Duplication of both of these subdomains might hint to a common regulatory mechanism.

Rpi-chc1 Homologous Loci in the Genome; Locus Directed Profiling.

In order to identify positions in the genome that contain Rpi-chc1 related nucleotide sequences a new technique was developed that is derived from the NBS profiling (Brugmans et al., 2008; van der Linden et al., 2004) and will be referred to as "locus directed profiling". Instead of the primers that were used previously, which target domains that are generally present in all R-genes, we now used primers that are conserved within the family of Rpi-chc1 sequences (Table 2). This way only Rpi-chc1 related genes are expected to be targeted. Genomic DNA from parents and offspring from different populations (SHxRH, 06-882) was digested with either RsaI, HaeIII, AluI or MseI. An adaptor was ligated to the digestion products and using an adaptor primer combined with the Rpi-chc1 family specific primer, multiple fragments of varying molecular weight were created in a PCR reaction. Polymorphic bands were detected in the two populations using the Licor polyacrylamide gelsystem. Polymorphic bands were

TABLE 3

Sequence distance table derived from alignment Rpi-chc1 with related RGAs from publically accessible databases

| | ABF81420 *populus*2.pro | ABF81421 *populus*.pro | BAB44079 *oryza*.pro | CAO40742 *vitis*.pro | CHC B2-1.pro | CHC B2-3.pro |
|---|---|---|---|---|---|---|
| ABF81420 *populus*2.pro | *** | 34.4 | 42.2 | 40.5 | 31.5 | 27.8 |
| ABF81421 *populus*.pro | 141.4 | *** | 38.8 | 39.7 | 42.2 | 40.3 |
| BAB44079 *oryza*.pro | 114.8 | 140.4 | *** | 50.4 | 34.9 | 31.2 |
| CAO40742 *vitis*.pro | 120.6 | 133.5 | 124.8 | *** | 37.1 | 32.5 |
| CHC B2-1.pro | 150.4 | 126.4 | 153.9 | 132.8 | *** | 78.1 |
| CHC B2-3.pro | 154.9 | 125.9 | 150.8 | 135.3 | 17.9 | *** |
| FOM2 *Cucumis melo*.pro | 151.5 | 122 | 160.6 | 144.8 | 137.9 | 136.5 |
| Gpa2.pro | 233 | 240 | 229 | 220 | 253 | 250 |
| AAR29073 blb1.pro | 126.8 | 141.8 | 130.9 | 104.3 | 147.5 | 149.3 |
| AAX89383 RPS! glycine max.pro | 102.5 | 146 | 126.6 | 133.2 | 156 | 160.2 |
| R3a.pro | 99.3 | 158 | 121.6 | 139 | 171.9 | 169.7 |
| | ABF81420 *populus*2.pro | ABF81421 *populus*.pro | BAB44079 *oryza*.pro | CAO40742 *vitis*.pro | CHC B2-1.pro | CHC B2-3.pro |

| | FOM2 *Cucumis melo*.pro | Gpa2.pro | AAR29073 blb1.pro | AAX89383 RPS! glycine max.pro | R3a.pro | |
|---|---|---|---|---|---|---|
| ABF81420 *populus*2.pro | 32.4 | 25.6 | 36.5 | 47 | 45.2 | ABF81420 *populus*2.pro |
| ABF81421 *populus*.pro | 43.5 | 30.4 | 38.4 | 34.1 | 33.1 | ABF81421 *populus*.pro |
| BAB44079 *oryza*.pro | 39.7 | 35.6 | 47.1 | 41.4 | 40.3 | BAB44079 *oryza*.pro |
| CAO40742 *vitis*.pro | 41.3 | 37.1 | 52.7 | 39.7 | 37 | CAO40742 *vitis*.pro |
| CHC B2-1.pro | 36.7 | 25.9 | 34.4 | 31.9 | 29.8 | CHC B2-1.pro |
| CHC B2-3.pro | 33.2 | 22.8 | 30 | 27.7 | 26.2 | CHC B2-3.pro |
| FOM2 *Cucumis melo*.pro | *** | 33.7 | 42.9 | 33.6 | 29.4 | FOM2 *Cucumis melo*.pro |
| Gpa2.pro | 262 | *** | 41.5 | 26.5 | 23.9 | Gpa2.pro |
| AAR29073 blb1.pro | 144.6 | 244 | *** | 37.5 | 33.4 | AAR29073 blb1.pro |

TABLE 3-continued

Sequence distance table derived from alignment Rpi-chc1 with related RGAs from publically accessible databases

| AAX89383 RPS! glycine max.pro | 158.8 | 230 | 134.4 | *** | 40.4 | AAX89383 RPS! glycine max.pro |
|---|---|---|---|---|---|---|
| R3a.pro | 175.5 FOM2 Cucumis melo.pro | 234 Gpa2.pro | 148 AAR29073 blb1.pro | 124.8 AAX89383 RPS! glycine max.pro | *** R3a.pro | R3a.pro |

Percent Similarity in upper triangle
Percent Divergence in lower triangle scored in 40 offspring plants from the SHxRH population and successively the marker segregation patterns were fitted to the UHD map (van Os et al., 2006). 73% of the markers mapped to the long arm of chromosome 10 where the Rpi-chc1 gene is located. Also sequence analysis of the isolated marker fragments showed strong homology to the Rpi-chc1 gene family (Table 4b). Altogether these data show that "locus directed profiling" was a successful approach to generate markers in a specified genomic area. On chromosome 10 three different loci were tagged with high frequency (Table 4A). Interestingly, the first two loci coincided with the map positions of contigs 2203 and 6701, which map to RH10B38-39 and RH10B41-42 respectively. A third group of markers mapped to RH10B54. Interestingly, the Rpi-ber1 gene (Park et al., 2008) is in the same marker interval as the RH10B54 cluster. In order to test whether the Rpi-ber gene was potentially a Rpi-chc1 homolog, in population 06-882, 58 Rpi-chc1 locus directed profiling markers were developed. 34 of these markers derived from the resistant parent. 28 of them were linked to resistance (9 in coupling phase, 19 in repulsion phase). 2 coupling phase markers and 7 repulsion phase markers were completely linked to resistance in the first 1771 individuals of the population. This strongly suggests that Rpi-ber is a Rpi-chc1 homolog. Within the 28 linked Rpi-chc1 locus directed profiling markers, four groups of recombination patterns could be distinguished, each group is marked by the name of a representative marker in FIG. 1A. Three marker groups match the RH10B38-39 cluster, one marker group matches the RH10B41-42 cluster. This result confirms our finding from the SHxRH population, that the family of Rpi-chc1 related sequences on chromosome 10 is located in at least two closely linked clusters.

TABLE 4a

Map positions in SH and RH genomes of Rpi-chc1 locus directed profiling markers

| MarkerName | SHPosition | SHRecFreq | RHPosition | RHRecFreq | LOD |
|---|---|---|---|---|---|
| R1A2 | SH10B016-020 | 0.894737 | | | 5.885886 |
| R2R13 | SH10B016-020 | 0.897436 | | | 6.139272 |
| R2R14 | SH10B016-020 | 0.897436 | | | 6.139272 |
| F2A4 | SH10B016-020 | 0.974359 | | | 9.720427 |
| R2A6 | SH10B016-020 | 0.974359 | | | 9.720427 |
| F2M2 | SH10B016-020 | 0.974359 | | | 9.720427 |
| F2M3 | SH10B016-020 | 0.974359 | | | 9.720427 |
| F2M9 | SH10B016-020 | 0.974359 | | | 9.720427 |
| R1M4 | SH10B016-020 | 0.974359 | | | 9.720427 |
| R1M10 | SH10B016-020 | 0.974359 | | | 9.720427 |
| R1M11 | SH10B016-020 | 0.974359 | | | 9.720427 |
| R1M12 | SH10B016-020 | 0.974359 | | | 9.720427 |
| R2M2 | SH10B016-020 | 0.974359 | | | 9.720427 |
| R2M4 | SH10B016-020 | 0.974359 | | | 9.720427 |
| R2R9 | SH10B016-020 | 0.974359 | | | 9.720427 |
| R1R8 | SH10B016-020 | 1 | | | 11.43914 |
| R2A8 | SH10B016-020 | 0.0479850 | RH10B022-26 | 0.951954 | 6.746727 |
| R1A4 | SH10B022-027 | 0.087129 | RH10B027-041 | 1 | 8.351405 |

TABLE 4a-continued

Map positions in SH and RH genomes of Rpi-chc1 locus directed profiling markers

| MarkerName | SHPosition | SHRecFreq | RHPosition | RHRecFreq | LOD |
|---|---|---|---|---|---|
| R2H5 | SH10B016-020 | 0 | RH10B027-048 | 0.952381 | 8.250089 |
| F2A1 | SH10B016-020 | 0 | RH10B027-048 | 0.954545 | 8.831465 |
| F2A5 | SH10B016-020 | 0 | RH10B027-048 | 0.954545 | 8.831465 |
| F2A6 | SH10B016-020 | 0 | RH10B027-048 | 0.954545 | 8.831465 |
| F2A7 | SH10B016-020 | 0 | RH10B027-048 | 0.954545 | 8.831465 |
| F2A8 | SH10B016-020 | 0 | RH10B027-048 | 0.954545 | 8.831465 |
| F2A9 | SH10B016-020 | 0 | RH10B027-048 | 0.954545 | 8.831465 |
| F2A10 | SH10B016-020 | 0 | RH10B027-048 | 0.954545 | 8.831465 |
| R2A3 | SH10B016-020 | 0 | RH10B027-048 | 0.954545 | 8.831465 |
| F2M4 | SH10B016-020 | 0 | RH10B027-048 | 0.954545 | 8.831465 |
| F2M8 | SH10B016-020 | 0 | RH10B027-048 | 0.954545 | 8.831465 |
| R1M7 | SH10B016-020 | 0 | RH10B027-048 | 0.954545 | 8.831465 |
| R1M8 | SH10B016-020 | 0 | RH10B027-048 | 0.954545 | 8.831465 |
| R2M3 | SH10B016-020 | 0 | RH10B027-048 | 0.954545 | 8.831465 |
| R2M9 | SH10B016-020 | 0 | RH10B027-048 | 0.954545 | 8.831465 |
| R2M11 | SH10B016-020 | 0 | RH10B027-048 | 0.954545 | 8.831465 |
| R2M16 | SH10B016-020 | 0 | RH10B027-048 | 0.954545 | 8.831465 |
| F2R1 | SH10B016-020 | 0 | RH10B027-048 | 0.954545 | 8.831465 |
| R1R1 | SH10B016-020 | 0 | RH10B027-048 | 0.954545 | 8.831465 |
| R1R2 | SH10B016-020 | 0 | RH10B027-048 | 0.954545 | 8.831465 |
| R2R5 | SH10B016-020 | 0 | RH10B027-048 | 0.954545 | 8.831465 |
| R2R10 | SH10B016-020 | 0 | RH10B027-048 | 0.954545 | 8.831465 |
| R1M6 | SH10B025-027 | 0 | RH10B027-048 | 0.954545 | 9.308586 |
| F2R4 | SH10B032-034 | 0 | RH10B027-048 | 0.857143 | 5.903571 |
| R1A3 | | | RH10B038-039 | 0.114286 | 5.134121 |
| R2H3 | | | RH10B038-039 | 0.128205 | 5.253783 |
| R1M3 | | | RH10B038-039 | 0.078947 | 6.881108 |
| R1M5 | | | RH10B038-039 | 0.078947 | 6.881108 |
| F2A3 | | | RH10B038-039 | 0.076923 | 7.146904 |
| R2A2 | | | RH10B038-039 | 0.076923 | 7.146904 |
| R2A7 | | | RH10B038-039 | 0.076923 | 7.146904 |
| R1H1 | | | RH10B038-039 | 0.076923 | 7.146904 |
| R2H4 | | | RH10B038-039 | 0.076923 | 7.146904 |
| R2M12 | | | RH10B038-039 | 0.076923 | 7.146904 |
| R2M13 | | | RH10B038-039 | 0.076923 | 7.146904 |
| R1R9 | | | RH10B038-039 | 0.076923 | 7.146904 |
| R2R1 | | | RH10B038-039 | 0.076923 | 7.146904 |

TABLE 4a-continued

Map positions in SH and RH genomes of Rpi-chc1 locus directed profiling markers

| MarkerName | SHPosition | SHRecFreq | RHPosition | RHRecFreq | LOD |
|---|---|---|---|---|---|
| R2R3 | | | RH10B038-039 | 0.076923 | 7.146904 |
| R2R2 | | | RH10B041 | 0.102564 | 6.139272 |
| R2M7 | | | RH10B041 | 0.076923 | 7.146904 |
| R2R8 | | | RH10B041 | 0.076923 | 7.146904 |
| F2A14 | | | RH10B042-048 | 0.076923 | 7.146904 |
| R2M8 | | | RH10B042-048 | 0.076923 | 7.146904 |
| R1R4 | | | RH10B042-048 | 0.076923 | 7.146904 |
| R1R5 | | | RH10B042-048 | 0.076923 | 7.146904 |
| R1R6 | | | RH10B042-048 | 0.076923 | 7.146904 |
| R2R12 | | | RH10B042-048 | 0.076923 | 7.146904 |
| R2R15 | | | RH10B042-048 | 0.076923 | 7.146904 |
| R1A5 | | | RH10B042-048 | 0.054054 | 7.759088 |
| F2M7 | SH10B047-049 | 1 | RH10B054 | 0.125 | 5.821641 |
| F2A11 | SH10B047-049 | 1 | RH10B054 | 0.055556 | 6.535189 |
| F2M5 | SH10B047-049 | 1 | RH10B054 | 0.055556 | 6.535189 |
| R1R7 | SH10B047-049 | 1 | RH10B054 | 0.055556 | 6.535189 |
| R2R7 | SH10B047-049 | 1 | RH10B054 | 0.055556 | 6.535189 |
| F2A12 | SH10B047-049 | 0.128205 | | | 5.253783 |
| R1M1 | | | RH02B023-025 | 0.921053 | 6.881108 |
| R1M2 | | | RH02B023-025 | 0.078947 | 6.881108 |
| R1R3 | | | RH04B014-020 | 0.076923 | 7.146904 |
| F1R3 | | | RH04B033-039 | 0.868421 | 5.013173 |
| R2M14 | | | RH04B033-039 | 0.974359 | 9.720427 |
| F2A2 | | | RH07B068-069 | 0.897436 | 6.139272 |
| R2A4 | SH12B051-058 | 0.896552 | RH12B047-051 | 1 | 5.807144 |
| R2R11 | SH12B051-058 | 0.931034 | RH12B047-051 | 1 | 6.35823 |
| F2H3 | SH12B051-058 | 0.933333 | RH12B047-051 | 1 | 6.452677 |
| F2M6 | SH12B051-058 | 0.933333 | RH12B047-051 | 1 | 6.452677 |
| R2M6 | SH12B051-058 | 0.933333 | RH12B047-051 | 1 | 6.452677 |
| F1R2 | SH01B033-034 | 0.897436 | | | 6.139272 |
| F1H5 | SH01B033-034 | 0.078947 | | | 6.881108 |
| F1R4 | SH01B033-034 | 0.941176 | | | 6.931596 |
| F1H3 | SH01B033-034 | 0.948718 | | | 8.314174 |
| F1H4 | SH04B024-030 | 0.102564 | | | 6.139272 |
| R2M15 | SH04B031-032 | 0.128205 | | | 5.253783 |
| R2A1 | SH04B031-032 | 0.102564 | | | 6.139272 |
| R2M1 | SH04B031-032 | 0.102564 | | | 6.139272 |
| R2R6 | SH07B048-057 | 0.078947 | | | 6.881108 |
| R2M5 | SH07B048-057 | 0.076923 | | | 7.146904 |

TABLE 4a-continued

Map positions in SH and RH genomes of Rpi-chc1 locus directed profiling markers

| MarkerName | SHPosition | SHRecFreq | RHPosition | RHRecFreq | LOD |
|---|---|---|---|---|---|
| F2M1 | SH09B049-054 | 0.897436 | | | 6.139272 |
| F2R2 | SH09B049-054 | 0.897436 | | | 6.139272 |

TABLE 4b

Sequence homology of Rpi-chc1 locus directed profiling markers derived from SHxRH population

| markername | Seq. length | blastx hit |
|---|---|---|
| F1R5 | 180 | |
| F1R6 | 185 | |
| F1R7 | | |
| F1R8 | 225 | ref|YP_514854.1 ribosomal protein S4 type |
| F1R9 | 230 | NBS-LRR type |
| F2A1 | 180 | gb|ABB91438.1| R-FOM-2 (*Cucumis melo*), NBS-LRR type |
| F2A2 | 225 | gb|ABB91438.1| R-FOM-2 (*Cucumis melo*), NBS-LRR type |
| F2A3 | 119 | |
| F2R1 | | |
| F2R2 | | |
| F2R4 | 145 | |
| F2R6 | 424 | NBS-LRR type |
| F2R7 | | |
| R1A1 | 305 | gb|ABB91438.1| R-FOM-2 (*Cucumis melo*), NBS-LRR type |
| R1A2 | 495 | No significant similarity found |
| R1R10 | 700 | gb|AAS80152.1| FOM-2 (*Cucumis melo*), NBS-LRR type |
| R1R11 | 461 | NBS domain resistance protein |
| R1R2 | | |
| R1R3 | | |
| R1R5 | 515 | emb|CAD29726.1| hero resist. Prot. 2 homologue NBS-LRR type |
| R1R6 | 510 | emb|CAD29726.1| hero resist. Prot. 2 homologue NBS-LRR type |
| R1R7 | 570 | No significant similarity found |
| R1R8 | 700 | gb|AAS80152.1| FOM-2 (*Cucumis melo*), NBS-LRR type |
| R2A1 | | |
| R2A2 | | |
| R2A3 | | emb|CAN82053.1| hypothetical protein (*Vitis vinifera*), NBS-LRR type |
| R2A4 | | dbj|BAB44079.1| putative NBS-LRR type (*Oryza sativa*), NBS-LRR type |
| R2R10 | | |
| R2R12 | | dbj|BAB44079.1| putative NBS-LRR type (*Oryza sativa*), NBS-LRR type |
| R2R13 | | dbj|BAB44079.1| putative NBS-LRR type (*Oryza sativa*), NBS-LRR type |
| R2R14 | | dbj|BAB44079.1| putative NBS-LRR type (*Oryza sativa*), NBS-LRR type |
| R2R15 | | emb|CAN82053.1| hypothetical protein (*Vitis vinifera*), NBS-LRR type |
| R2R16 | | No significant similarity found |
| R2R17 | | emb|CAN82053.1| hypothetical protein (*Vitis vinifera*), NBS-LRR type |
| R2R2 | | emb|CAN82053.1| hypothetical protein (*Vitis vinifera*), NBS-LRR type |
| R2R3 | | emb|CAN82053.1| hypothetical protein (*Vitis vinifera*), NBS-LRR type |
| R2R4 | | emb|CAN82053.1| hypothetical protein (*Vitis vinifera*), NBS-LRR type |
| R2R5 | | emb|CAN82053.1| hypothetical protein (*Vitis vinifera*), NBS-LRR type |
| R2R6 | | emb|CAN82053.1| hypothetical protein (*Vitis vinifera*), NBS-LRR type |
| R2R7 | | emb|CAN82053.1| hypothetical protein (*Vitis vinifera*), NBS-LRR type |
| R2R9 | | emb|CAN82053.1| hypothetical protein (*Vitis vinifera*), NBS-LRR type |

In a different population (7677) deriving from *S. berthaultii* accession 493-7 an NBS profile marker generated with the previously described NBS5a6 primer was found to be closely linked to *Phytophthora* resistance in this population. It mapped to the telomeric site relative to TG403 on the long arm of chromosome 10 (FIG. 6). Sequence analysis of this fragment revealed high homology to members of the Rpi-chc1 family. All together these results show that at least four, genetically different, Rpi-chc1 like clusters are present on chromosome 10. This is similar to the situation on the long arm of chromosome 9, where three different Tm2-2 related clusters were identified (Foster et al., 2009; Pel et al., 2009).

Plant Material and *Phytophthora infestans* Isolates

In this study we used four late blight resistant clones TAR852-5 (deriving from CGN22729), BER94-2031-01 (deriving from PI473331), BER481-3 (deriving from CGN18190) BER493-7 (deriving from CGN17823), CHC543-5 (deriving from BGRC63055). CHC543-5 was crossed with CHC544-5 to produce population 7650.

BER94-2031-01 was crossed with the susceptible clone G254 to generate population 06-882. BER493-7 was crossed with RH89-039-16 to produce population 7677. Potato cultivar Desiree was used for transformation. Wild-type *Nicotiana benthamiana* plants were used for transient complementation assays.

Characteristics and origin of *P. infestans* isolates used in this study are indicated in Table 5.

BAC Library Construction

Clone CHC543-5 was used as a DNA source for the construction of the BAC libraries. High-molecular weight DNA preparation and BAC library construction were carried out as described by (Rouppe van der Voort et al., 1999). For the first library pCC1BAC backbone was used. For the second library pIndigoBAC-5 was used, both from Epicenter. Approximately 22,000 clones with an average insert size of ~70 Kbp, corresponding to 1 genome equivalents, were obtained for library 1, and approximately 110,000 clones with an average insert size of ~45 Kbp, corresponding to 3 genome equivalents, were obtained for library 2. The BAC clones were stored as bacterial pools containing approximately 700 to 1000 white colonies. These were generated by scraping the colonies from the agar plates and successive resuspension into LB medium containing 18% glycerol and 12.5 μg ml$^{-1}$ chloramphenicol using a sterile glass spreader. These so-called super pools were stored at −80° C. Marker screening of the BAC libraries was done, first by isolating plasmid DNA from each pool using the standard alkaline lysis protocol and PCR was carried out to identify positive pools. Bacteria corresponding to positive pools were diluted and plated on LB agar plate containing chloramphenicol (12.5 μg ml$^{-1}$). Individual white colonies were picked into 384-well microtitre plates and single positive BAC clones were subsequently identified by marker screening as described by (Rouppe van der Voort et al., 1999). Names of BAC clones isolated from the super pools carry the prefix CHC and are extended with a number (B1 and B2), corresponding to the order in which they were identified.

Subcloning of Candidate Genes

Longrange PCR

Candidate RGAs were subcloned from BAC clone CHC B2 as follows. Primers were designed approximately 3 kb upstream of the predicted start codon and approximately 700 bp downstream of the predicted stop codon.

```
(CHC B2-1F =

MN459:
                              (SEQ ID NO: 104)
tgaccctgcaggGGACCCCTTAACAAGTGATGTG, CHC B2-R = MN462:
                              (SEQ ID NO: 105)
tgacggcgcgccAAAAAGTCCCGCTTTGATACC, CHC B2-2F = MN483:
                              (SEQ ID NO: 106)
tgacccctgcaggCCCCTTAACAAGTGATGTGATG, CHC B2-2R = MN484:
                              (SEQ ID NO: 107)
tgacggcgcgccTCAGGTTCCCTTACAAGATTCC, CHC B2-3F = MN479:
                              (SEQ ID NO: 108)
tgacccctgcaggACGCATCAGGAAGAGAGGAG, CHC B2-3R = MN480:
                              (SEQ ID NO: 109)
tgacggcgcgccGCGGTTCCTCTGTGAAACAC).
```

DNA Sequencing and Computer Analysis

BAC clone sequencing was performed using a shotgun cloning strategy of 2 kb and 6 kb libraries and was carried out by Macrogen (South-Korea). Sequencing reactions were performed using the dye terminator principle. Sequence contigs were assembled by Macrogen. Gap closing was done using primer walking on shotgun clones or directly on the BAC.

The contig sequences were analyzed using the web-based application FGENESH (Softberry) in order to predict gene structure. RGAs and RGAs from publically accessible databases were aligned for homology and distance analysis using the DNA star software package (Lasergene). Conserved domains were identified using the web-based application SMART (EMBL)

Resistance Assay

Detached leaf assays were used to determine the resistance phenotypes of primary transformants and *N. benthamiana* leaves. For the phenotyping of the CHC population isolate 90128 was used. For the phenotyping of the ber population, isolate IPO-C was used. The resistance spectra of the resistant parents was determined using the isolates described in Table 5. Inoculum preparation and inoculation were performed as described by (Vleeshouwers et al., 1999). Six days after inoculation, plant phenotypes were determined. Leaves showing no symptoms or a localized necrosis at the point of inoculation were scored as resistant and those with clear sporulating lesions as susceptible.

Transient Complementation in *N. benthamiana*

*Agrobacterium* transient transformation assays (agro-infiltration) were carried out on *N. benthamiana*. Recombinant *A. tumefaciens* AGL1+ cultures were grown in LB medium (10 gram bacteriological peptone, 10 gram NaCl and 5 gram yeast extract in 1 liter MQ water) supplemented with 5 mg/l Tetracycline and 50 mg/l Kanamycin for the pBINplus constructs. After one or two days a calculated amount of culture (according to OD 0.5 at 600 nm) was transferred to YEB medium (5 gram beef extract, 5 gram bacteriological peptone, 5 gram sucrose, 1 gram yeast extract, 2 ml 1 M MgSO4 in 1 liter MQ water) supplemented with Kanamycin for all strains. After 1 day overnight cells were centrifuged at 3500 rpm and re-suspended in MMA medium (20 gram sucrose, 5 gram MS salts and 1.95 gram MES) supplemented with 1 ml 200 mM acetosyringone to a final OD of 0.2 and infiltrated into 4 weeks old plants with a 3 ml syringe. Infiltrated leaves were subsequently challenged after two days with *P. infestans* strain 90128 in detached leaf assays (DLA). Hypersensitive response (HR) or *P. infestans* sporulation were scored from 5 to 7 days post inoculation.

Example 2

Rpi-chc1 is a Functional Resistance Gene Against *Phytophthora infestans*

Methods

Plant Material and *Phytophthora infestans* Isolates

In this study we used 225 *Solanum* plants, their names as used in this study and accession numbers are listed in Table 7. Nine late blight resistant plants were used for the isolation of functional homologs of Rpi-chc1 (tar852-5, ber94-2031-01 which derives from PI473331, ber481-3, ber493-5, -7, -9, chc543-5, ber324-2, ber487-1, ber561-2, and scr849-1). CHC543-5 was crossed with CHC544-5 to produce population 7650. BER94-2031-01 was crossed with the susceptible clone G254 to generate population 06-882. BER493-7 was crossed with RH89-039-16 to produce population 7677.

Potato cultivar Desiree was used for transformation. Wild-type *Nicotiana benthamiana* plants were used for transient complementation assays.

Characteristics and origin of *P. infestans* isolates used in this study are indicated in Table 5.

Cloning of Candidate Genes

Rpi-chc1 homologs were PCR amplified using the long range high fidelity thermostable DNA polymerase Phusion® according to the manufacturer's instructions (New England Biolabs). Primers were designed, overlapping the start and stop codons of Rpi-chc1 and contained AttB1 and AttB2 extensions (MN595 and MN597, Table 8). PCR products were recombined into pDONR221 using BP clonase® according to manufacturer's instructions (InVitroGen). DNA sequencing was performed at Baseclear (The Netherlands) using standard and custom primers (MN622-MN650, Table 8). Sequences were analyzed and aligned for homology and phylogeny analysis using the DNA star software package (Lasergene).

Promoter Terminator Constructs

In order to produce clones containing the promoter and terminator of Rpi-chc1 for construction of triple point gateway application mediated expression constructs, specific primers were designed (MN598, MN599, MN600, MN601, MN670; Table 8) matching the Rpi-chc1 promoter and terminator sequences, to which AttB4, AttB1 and AttB2, AttB3 recombination sites were added, respectively. PCR products were generated using the long range high fidelity thermostable DNA polymerase Phusion® according to the manufacturer's instructions. PCR products were recombined using BP clonase®. The occurrence of PCR errors was ruled out using sequence analysis of the resulting clones using primers MN651 and 652 as listed in Table8. Triple point gateway reactions were performed using these constructs and ORF sequences in pDONR221 by LR clonase.

Resistance Assay

Detached leaf assays were used to determine the resistance phenotypes of primary transformants and *N. benthamiana* leaves. For the phenotyping of the CHC transgenics isolate 90128 was used. For the phenotyping of the Rpi-chc1 homologs in *N. benthamiana*, isolate IPO-C was used. Inoculum preparation and inoculation were performed as described by Vleeshouwers et al., 1999. Six days after inoculation, plant phenotypes were determined. Leaves showing no symptoms or a localized necrosis at the point of inoculation were scored as resistant and those with clear sporulating lesions as susceptible.

Transient Complementation in *N. benthamiana*

*Agrobacterium* transient transformation assays (agro-infiltration) were carried out on *N. benthamiana*. Recombinant *A. tumefaciens* COR308 cultures were grown in LB medium (10 gram bacteriological peptone, 10 gram NaCl and 5 gram yeast extract in 1 liter MQ water) supplemented with 5 mg/l tetracycline and 50 mg/l kanamycin for the pBINplus constructs. After one or two days a calculated amount of culture (according to OD 0.5 at 600 nm) was transferred to YEB medium (5 gram beef extract, 5 gram bacteriological peptone, 5 gram sucrose, 1 gram yeast extract, 2ml 1 M Mg504 in 1 liter MQ water) supplemented with kanamycin for all strains. After 1 day overnight cells were centrifuged at 3500 rpm and re-suspended in MMA medium (20 gram sucrose, 5 gram MS salts and 1.95 gram MES) supplemented with 1 ml 200 mM acetosyringone to a final OD of 0.2 and infiltrated into 4 weeks old plants with a 3ml syringe. Infiltrated leaves were subsequently challenged after two days with *P. infestans* strain 90128 in detached leaf assays (DLA). Hypersensitive response (HR) or *P. infestans* sporulation were scored from 5 to 7 days post inoculation Co-infiltration A set of 90 effectors was present in Agrobacterium tumefaciens COR308 in a PVX plasmid (PEX set). The binary plasmids contain an effector from Pi cloned inside the PVX genome. Upon agro-infiltration both effector and PVX will be expressed. Within the time course of the experiment PVX can not spread systemically and we are only interested in the local expression of the effector. Upon recognition of the encoded effector by the R-gene, an HR can be observed between 3 and 5 dpi. PVX symptoms are visible after 6 days and are generally first observed in non-infiltrated leaves.

As a positive control we used R3α and Avr3a-KI, an R-gene-Avr-gene combination which is known to give a strong response (Armstrong et al., 2005). Screening with the Rpi-chc1 candidate showed necrotic spots with two potential effectors genes RD 12-1 and RD 12-2 (FIG. 8).

In the previous example we described the map based cloning of the Rpi-chc1 gene from *Solanum chacoense* accession 543-5. Rpi-chc1 is the founder of a previously undescribed R gene family of the CC-NB-LRR class and is located on chromosome 10 near marker TG63. The gene was present in a gene cluster with five homologs. Genetic analysis revealed that only three of these homologs (CHC B2-1, CHC B2-2, and CHC B2-3 could potentially encode Rpi-chc1. Transient complementation analysis in *N. benthamiana* suggested that CHC B2-3 was the active copy.

In this experiment we show by stable transformation of the susceptible cv. Desiree that indeed CHC B2-3 could complement the *Phytophthora infestans* (Pi) susceptibility (FIG. 8). This result supports our previous suggestion that CHC B2-3 is Rpi-chc1. Also this result shows that Rpi-chc1 can be functional in a broad spectrum of Solanaceous species, such as *S. chacoense* and *N. benthamiana* but also in *S. tuberosum*.

Rpi-chc1 Specifically Recognizes an RXLR Effector Protein.

In order to understand the activity spectrum of Rpi-chc1, it was investigated which component of Pi was recognized. Until now all Pi components being recognized by host R-proteins are effectors of the RXLR class. Pi isolate T30-4 is a-virulent on plants expressing Rpi-chc1 and therefore the cognate component must be expressed in this isolate. Recently the genome of T30-4 was sequenced and its genome appears to encode hundreds of RXLR effectors (Haas et al., 2009). Sixty-five RXLR effectors comprising all known Avr's (Avr1, Avr2, Avr3a, Arv4, Avr-blb1, Avr-blb2) and also a few non RXLR effectors (Infl, PiNIP) effectors were cloned into the plant expression vector pGR106 and are referred to as the PEX set (Vleeshouwers et al., 2008). The PEX set was screened by co-agro-infiltration with Rpi-chc1 in *N. benthamiana*. This way both the selected effector and the Rpi-chc1 gene are expressed in the same cells. In case the effector is recognized by Rpi-chc1 it will induce a hypersensitive response (HR) and will result in a necrotic lesion in the infiltrated area of the leaf. This phenomenon was well described for the co-infiltration of R3a and Avr3a (Armstrong et al., 2005) which was included in our experiments as a positive control (FIG. 9). Leaf areas that were agro-infiltrated with Rpi-chc1 alone remained green which showed that Rpi-chc1 in itself did not induce cell death. Also co-infiltration with the previously described Avr's (Avr1, Avr2, Avr3a, Arv4, Avr-blb1, Avr-blb2) did not induce HR, which showed that Rpi-chc1 recognizes a new component of Pi and that it has a unique way of inducing resistance. On the other hand some effectors in the PEX set produced an Rpi-chc1 independent hypersensitive response (FIG. 9 leaf C). There were, however also two clones in the PEX set that only showed an Rpi-chc1 dependent cell death (FIG. 9 leaf B). Both clones (RD 12-1 and RD 12-2) were highly homologous to each other and in fact encoded identical proteins. RD31, that encodes a protein with 60% identity to RD12 was not recognized (FIG. 9 leaf A), showing that recognition by Rpi-chc1 was quite specific. In order to test the specificity of recognition on the R-gene side, RD12 was co-infiltrated with Rpi-blb1, Rpi-blb3 and R3a. Also the Rpi-chc1 paralogs CHC B2-1 and CHC B2-2 (see Example 1), which showed 78% and 83% identity, respectively, at the amino acid level to Rpi-chc1, were tested by co-infiltration. None of these R-genes or R-gene paralogs produced a hypersensitive response upon co-infiltration with RD12 (data not shown). These results clearly showed that Rpi-chc1 could specifically recognize Pi component RD 12. RD12 (=PITG_16245 has several paralogs in the Pi genome (PITG_16418, PITG_16427, PITG_16233, PITG_16240, PITG_20934, PITG_20936, PITG_20336, and PITG_23230), of which the sequences are given below.

PITG_16245  MATATVLVQSPASGLTTTVADTAQTATSILTPVLA
            GEPNKHVTTRSLRTHPIADSDDGEERLLNGMTDFV
            KYHAGKMNPEQLYKYLKLQGRGQEAYKHKNYASYI
            KKSKKWWK
            (SEQ ID NO: 127)

PITG_16418  MATATVLVQSPASGLTTTVADTAQTATSILTPVLA
            GEPNKHVTTRSLRTHPIADSDDGEERLLNGMTDFV
            KYHAGKMNPEQLYKYLKLQGRGQEAYKHKNYASYI
            KKSKKWWKNQ
            (SEQ ID NO: 128)

PITG_16427  MRVLCLALMATATVLVPSPASGLTTTVADTAQTAT
            SILTPVLAGEPNKHVTTRSLRTHPIADSDDGEERL
            NGMTDFVKYHAGKMLNPEQLYKYLKLQGRGQEAYK
            HKNYASYIKKSKKWWKNQ
            (SEQ ID NO: 129)

PITG_16233  MRVLCLALMATATVLVQSPASGLTTTVADTAQTAT
            SILTPVLAGEPNKHVATRSLRTHPIDDSDDGEERL
            LNGMTDFFKYHAGKMSPEQLYKYLNLKGLGQEAYK
            HKNYASYIKKSKKWWKNQ
            (SEQ ID NO: 130)

PITG_16240  MRVLCLALMATATVLVQSPASGLTTTVADTAQTAT
            SILTPVLAGEPNKHVATRSLRTHPIDDSDDGEERL
            LNGMTDFFKYHAGKMSPEQLYKYLNLKGLGQEAYK
            HKNYASYIKKSKKWWKNQ
            (SEQ ID NO: 131)

PITG_20934  MRVLCLALMATATVLVPSPASGLTTTVADTAQTAT
            SILTPVLAGEPNKHVATRSLRTHPIDDSDDGEERL
            LNGMTDFFKYHAGKMSPEQLYKYLNLKGLGQEAYK
            HKNYASYIKKSKKWWKNQ
            (SEQ ID NO: 132)

PITG_20936  MRVLCLALMATATVLVPSPASGLTTTVADTAQTAT
            SILTPVLAGEPNKHVATRSLRTHPIDDSDDGEERL
            LNGMTDFFKYHAGKMSPEQLYKYLNLKGLGQEAYK
            HKNYASYIKKSKKWWKNQ
            (SEQ ID NO: 133)

PITG_20336  MRVLCLALMATATVLVPSPASGLTTTVADTAQTAT
            SILTPVLAGEPNKHVATRSLRTHPIDDSDDGEERL
            LNGMTDFFKYHAGK
            (SEQ ID NO: 134)

PITG_23230  MRVLCLALMATATVLVPSPASGLTTTVADTAQTAT
            SILTPVLAGEPNKHVATRSLRTHPIDDSDDGEERL
            (SEQ ID NO: 135)

It can not be excluded that also these paralogs are recognized by Rpi-chc1 in the interaction with Pi. Neither can it be ruled out that additional unrelated Pi components can be recognized since dual specificity R-genes have been described (Jones and Dangl, 2006).

Promotor Requirement for Rpi-chc1 Expression

In order to determine which regulatory sequences were most suited to drive the expression of the open reading frames of Rpi-chc1, we used the strategy described before (Lokossou et al., 2009) in which the candidate ORFs are cloned in between the desired promoters and terminators using a triple point gateway strategy. The Rpi-chc1 ORF was cloned in between its own 3 kb promoter and 0.5 kb terminator (p-chc1-long) which were also present in the initial complementation analyses as presented in FIG. 8. In addition, Rpi-chc1 ORF was cloned in between three alternative promoter/terminator combinations. A shorter version (0.8 kb) of its own promoter and its own 0.6 kb terminator (p-chc1 -short); the double 35S promoter in pMDC32, and the Rpi-blb3 promoter/terminator combination (Lokossou et al., 2009). In order to test which was the optimal promoter terminator combination, the four Rpi-chc1 constructs were transformed to AGL-1+virG, cultures were mixed 1:1 with *A. tumefaciens* COR308 containing PEX-RD12. Serial dilutions in MMA medium were infiltrated in the leaves of *N. benthamiana* (FIG. 10). The p-chc1-long construct induced HR in mixtures with RD12 of $OD_{600}$ 2.0 and 1.0. The p-chc1-short construct also expressed HR in a two fold lower concentration ($OD_{600}$=0.5). Remarkably, the 35S and Rpi-blb3 promoter/terminator constructs were not suitable for functional expression of the Rpi-chc1 gene. These results show that the promoter of Rpi-chc1 is functionally distinct from the other promoters tested. Furthermore, it is concluded that sequences upstream (<−900 bp) in the Rpi-chc1 promoter contain inhibitory elements for expression.

Germplasm Screen for Rpi-chc1 like Sequences

To further support the suggestion that Rpi-chc1 can be active in a wide range of *Solanum* species and also study divergence of the Rpi-chc1 allele sequence and activity in the germplasm we screened 225 genotypes (Table 7) from our germplasm collection for the presence of Rpi-chc1 related sequences using a sequence alignment of the active Rpi-chc1 and several related sequences identified in the initial application that were derived from RH89-039-16 and from the inactive paralogs in chc543-5. Primer pairs (Table 8) were designed in such a way that only the active copy was predicted to be amplified by PCR. As shown in FIG. 11A, primer combinations D and E were highly specific since PCR products were observed only in reactions that contained the Rpi-chc1 template and no amplification was found from the templates that contained closely related sequences. Primer combinations D and E were used to screen the recombinants in the finemapping population (n=2400) of *S. chacoense* and *S. berthaultii* (n=2600; Rpi-ber; accession PI265858; 94-2031*G254) in which Pi resistance is segregating. No recombinants were found between the marker and the resistance in either population (data not shown). This showed that both markers are highly specific. Also this showed that the Rpi-ber gene is related to Rpi-chc1 and that Rpi-chc1 derived molecular markers can be used to tag these resistance genes.

Genotype chc543-5, from which Rpi-chc1 was isolated, is located in taxonomic group 10-14 (Jacobs et al., 2008). In order to screen for other Rpi-chc1 homologous sequences, 225 genotypes in our germplasm collection (Table 7) located in taxonomic groups 10-12 till 10-17 were selected. DNA integrity was confirmed using Ef1-α PCR (data not shown) and successively primer combination D was used to screen for Rpi-chc1 related sequences. Six genotypes were found to be positive in this screen (FIG. 11B). First of all chc543-5 was found, which confirmed the robustness of the screen. Besides, five other genotypes were identified amongst which *S. berthaultii* plants 324-2, 481-3 and 561-2, confirming the previous suggestion that Rpi-chc1 and Rpi-ber are very related. Also two other species were tagged, *S. tarijense* (852-5) and *S. sucrense* (849-1).

Rpi-chc1 Homolog Mining

In order to further characterize functional and sequence conservation or divergence of Rpi-chc1 we set out to clone the open reading frames from the plants that were positive in the germplasm screen and in addition from plants known to contain resistance genes on chromosome 10 (described in FIG. 6). Primers overlapping the start- and the stop codon of Rpi-chc1 were designed and attB1 and AttB2 extensions were added for BP cloning into pDONR221. PCR reactions using the proofreading polymerase Phusion® resulted in specific products for all selected genotypes. These PCR fragments were cloned and for each genotype six colonies were selected and end sequenced. Some genotypes produced only one sequence type and for those genotypes we concluded that only one target gene was amplified. For genotypes with two or more sequence types an additional 16 colonies were end sequenced and grouped. From each sequence group three clones were fully sequenced using Rpi-chc1 derived internal primers. This resulted in the identification of 21 new Rpi-chc1 like sequences (FIG. 13A-T). The encoded protein sequences were aligned using clustal-W together with previously identified Rpi-chc1 homologs (FIG. 14A-AQ). This resulted in the phylogenetic tree as presented in FIG. 12. From chc543-5 we isolated two sequence types. The first type was identical to Rpi-chc1. The second sequence type located in a different clade (clade 1 in FIG. 12) with multiple sequences, all deriving from *S. berthaultii* plants, showing that this approach was successful in identifying Rpi-chc1 homologs. Four genotypes yielded only one sequence type 849-1, RH89-39-16, 487-1 and 94-2031-1. The first three located to the same Clade (Clade 2 in FIG. 12). RH89-39-16 sequences RH_D3, D4, and D7 were identical to each other and showed two nucleotide mismatches with RH137D14 c13-2, a sequence that was generated during construction of the RH physical map in the initial application. Both sequences located to Clade 2 which also contained *S. sucrense* sequences 849-1_M8, M18, and M20, and also *S. berthaultii* sequences 487-1, I4, I6 and I8 was M20. In addition *S. tarijense* 852-5_E3 was present in Clade 2. Because RH89-39-16 is susceptible to Pi infection, it is suggested that these sequences represent inactive homologs. Two other sequences isolated from *S. tarijense* 852-5 located in Clade 3 which also harboured the Rpi-chc1 gene. Furthermore, three sequences from *S. berthaultii* plants 94-2031-1, 561-2, 324-2 were found in this Clade which showed only minor sequence deviation and encoded identical amino acid sequences. Clade 4 contained only sequences from *S. berthaultii* plants. Clade 5 contained only sequences that were identified before as also was the case in the remaining group, referred to as group 6. Clades 1 till 4 had a 45 a.a. N-terminal extension of the encoded protein as compared to proteins in Clade 5 and group 6. Sequences in Clade 2, 3 and 5 mapped to the R-gene cluster within 0.1 cM to TG63. No sequences in clades 1 and 4 have been genetically mapped. Comparison with the newly available *S. phureja* genome sequence revealed that sequences from Clade 1 till 5 had closest homologs in the TG63 cluster. Comparison to the tomato genome revealed that also here an Rpi-chc1 cluster near TG63 existed. As shown before, at this genetic location the Pi resistance gene Ph-2 was mapped. Some tomato plants, that were sequenced did not carry the Ph-2 resistance gene but a potential inactive allele could be present (FIG. 13A-T). Group 6 sequences had closest homology to a related R-gene cluster near TG403 on chromosome 10, an area where we also mapped Pi resistance (see FIG. 6), showing that also Rpi-chc1 homologous sequences from this cluster potentially encode Pi resistance.

Functional Analysis of Rpi-chc1 Hhomologs

Now we have identified 21 new Rpi-chc1 homologs and we have shown sequence diversification, the question arises if functionality is conserved or diversified among those sequences. All identified sequences, which are ORFs, were subcloned using triple point gateway recombination under the control of the Rpi-chc1-short promoter and the Rpi-chc1 terminator in the binary vector pDEST236. Based on the results in FIG. 10, this was considered the best constellation to drive the expression of the mined Rpi-chc1 homologs. Successively, the constructs were transformed into *A. tumefaciens* strain COR308 for transient complementation assays in *N. benthamiana*. Alternatively, for co-expression with the cognate Pi effector RD12, the Rpi-chc1 homologs were transformed into *A. tumefaciens* strain AGL1+virG. Both experiments are complementary since the transient complementation assay could show whether a Rpi-chc1 could induce resistance, the co-infiltration could indicate the recognition specificity of the gene. All experiments were repeated at least twice and the results are summarized in Table 9. Several combinations of RD12 responsiveness and IPO-C resistance can be observed. Two clear groups can be distinguished. A first group is not responsive to RD12 and is susceptible to IPO-C (group 1; Table 9). These sequences are inactive homologs and mainly locate in phylogenetic Clade 1 (FIG. 12). The second group (group 2; Table 9) are functional homologs of Rpi-chc1 since they are actively inducing resistance against Pi and they recognize the same Pi component (RD12). The sequences of this group are also clearly distinct from the other sequences since they all locate in Clade 3 (FIG. 12). *S. tarijense* 852-5 clone E28 induces HR in the absence of RD12 and is in that sense unique in its activity pattern and constitutes activity group 3. Since it does not induce resistance it is most likely an inactive allele. Another allele from the same plant (clone E14) does not recognize RD12 but does induce strong resistance. Activity group 4 is therefore distinct from group 2 because it most likely recognizes a different component from Pi. Activity group 5 is quite similar to group 4; the only difference is that disease resistance is not that strong. This suggests that also group 5 recognizes different components from Pi and will have a different resistance spectrum. The last group (Group 6) is distinct because RD 12 is only weakly recognised and also resistance is weak. Summarising, these data show that the closest related Rpi-chc1 homologs have a conserved resistance mechanism, while less related sequences have a more diversified resistance mechanism. Altogether, these data show that multiple members of the Rpi-chc1 gene family, with different extents of similarity, are functional in providing resistance again Pi.

TABLE 5

Characteristics of *P. infestans* isolates used in this study, and their interaction with chc, ber and tar accessions.

| Isolate ID | Collection | Country of origin | Race | Phenotype 543-5 | Phenotype 481-3 | Phenotype 94-2031 | Phenotype 852-5 |
|---|---|---|---|---|---|---|---|
| EC1[a] | | Ecuador | 3.4.7.11 | R | R | R | R |
| 3128-A | SCRI | | | R | R | nd | R |
| 51368 | PHYTO | | | R | R | R | R |
| 80029 | PHYTO | | | R | R | nd | R |
| 88069 | SCRI | | | R | R | R | R |
| 88133 | PHYTO | | | R | R | R | R |
| 89094 | PHYTO | | | R | R | R | R |
| 91011 | PHYTO | | | R | R | R | R |
| 99177 | Kessel, PRI, WUR (Flier et al., 2002) | 1999, Metepec, Mexico | 2.7 | R | R | R | R |
| 99183 | Kessel, PRI, WUR (Flier et al., 2002) | 1999, Metepec, Mexico | 1.3.7 | R | R | S | R |
| 99189 | Kessel, PRI, WUR (Flier et al., 2002) | 1999, Metepec, Mexico | 1.3.4.7.8.10 | R | R | nd | R |
| CA-65 | SCRI | | | R | R | nd | R |
| EC3364 | PHYTO | | | R | R | R | R |
| EC3425 | PBR | | | R | R | R | R |
| IPO-0(87000) | Kessel, PRI, WUR | Netherlands | 0 | R | R | R | R |
| NL05-194 | PHYTO | | | R | nd | S | S |
| SC95.173.2 | SCRI | | | R | R | R | R |
| SC96.9.5.1 | SCRI | | | R | R | R | R |
| UK7818 | PHYTO | | | R | R | R | R |
| UK7824 | PHYTO | | | R | R | R | R |
| US580 | PHYTO | | | R | R | R | R |
| 90128[a,b] | PHYTO | 1990, Geldrop, The Netherlands | 1.3.4.7.8.11 | R | R | R | R |
| H30P04[a] | | The Netherlands | 7 | R | R | R | R |
| IPO-C[a] | Kessel, PRI, WUR | 1990, Belgium | 1.2.3.4.6.7.10.11 | R | R | R | R |

R is resitant, S is susceptible, nd is not determined
[a]host potato,
[b]mating type A1

TABLE 6

R-genes and quantitative trait loci for late blight resistance reported for wild *Solanum* species

| Wild species | Locus type or name | Also known as | Chromosome | cloned | Reference |
|---|---|---|---|---|---|
| *S. berthaultii* | QTLs (4) | | I, III, VII and XI | | |
| | Rpi-ber | | X | | (Rauscher et al., 2006) |
| | Rpi-ber1 | | X | | (Park et al.) |
| | Rpi-ber2 | | X | | (Park et al.) |
| *S. bulbocastanum* | RB/Rpi-blb1 | RB | VIII | yes | (Song et al., 2003; van der Vossen et al., 2003) |
| | Rpi-blb2 | | VI | yes | Van der Vossen et al. 2005 |
| | Rpi-blb3 | | IV | yes | (Park et al., 2005a) |
| *S. caripense* | QTL (2) | | unassigned | | |
| *S. demissum* | R1 | | V | yes | (Ballvora et al., 2002) |
| | R2 | | IV | yes | (Park et al., 2005b) |
| | R3, R6, R7 | | XI | | |
| | R3a | | XI | yes | (Huang et al., 2005) |
| | R3b | | XI | | |
| | R5-R11 | | XI | | |
| | R10, R11 | | XI | | (Bradshaw et al., 2006) |
| *S. microdontum* | QTLs (3) | | IV, V and X | | (Tan et al., 2008) |
| *S. mochiquense* | QTL Rpi-mcq1 | (Rpi-moc1) | Unassigned IX | yes | |
| *S. papita* | Rpi-pta1 | | VIII | yes | (Vleeshouwers et al., 2008) |
| *S. paucissectum* | QTLs (3) | | X, XI and XII | | |
| *S. phureja* | Rpi-phu1 | | IX | | |

TABLE 6-continued

R-genes and quantitative trait loci for late blight resistance reported for wild *Solanum* species

| Wild species | Locus type or name | Also known as | Chromosome | cloned | Reference |
|---|---|---|---|---|---|
| *S. pinnatisectum* | Rpi-pnt1 | (Rpi1) | VII | | (Kuhl et al., 2001) |
| *S. stoloniferum* | Rpi-sto1 | | VIII | yes | (Wang et al., 2008) |
| *S. venturii* | Rpi-vnt1.1 | Rpi-phu1 | IX | yes | Foster et al. 2009 |
| | Rpi-vnt1.3 | | IX | yes | Pel et al. 2009 |
| *S. vernei* | QTLs (several) | | VI, VIII, IX | | |
| Hybrids with *S. tuberosum* | Rpi-abpt | | IV | yes | Lokosou et al. 2009 |
| | R2-like | | IV | yes | (Park et al., 2005b) |

TABLE 7

Genotypes screened for Rpi-chc1 related sequences. Taxonomic groups refer to regrouping of *Solanum* section petota by (Jacobs et al., 2008)

| GENOTYPE code | tree main group | tree sub group | species, accesssion nr |
|---|---|---|---|
| 4-11 | 10 | 12 | *arnezii* PI545880 |
| 98-1 | 10 | 12 | *yungasense* PI614703 |
| 109-1 | 10 | 16 | *aracc-papa* GLKS82 |
| 110-1 | 10 | 16 | *aracc-papa* GLKS81 |
| 110-4 | 10 | 16 | |
| 111-1 | 10 | 12 | *arnezii* GLKS2832 |
| 114-5 | 10 | 16 | *astleyi* GLKS2836 |
| 123-2 | 10 | 16 | *candolleanum* GLKS2175 |
| 142-4 | 10 | 17 | *curtilobum* GLKS5346 |
| 144-3 | 10 | 16 | *doddsii* GLKS2882 |
| 144-5 | 10 | 16 | *doddsii* GLKS2882 |
| 165-2 | 10 | 16 | species GLKS1512 |
| 171-2 | 10 | 16 | |
| 187-2 | 10 | 17 | *morelliforme* BGRC7200 |
| 194-1 | 10 | 17 | *ochranthum* BGRC53684 |
| 194-3 | 10 | 17 | *ochranthum* BGRC53684 |
| 194-22 | 10 | 17 | species BGRC53684 |
| 194-23 | 10 | 17 | species BGRC53684 |
| 194-25 | 10 | 17 | species BGRC53684 |
| 200-4 | 10 | 17 | *phureja* GLKS1467 |
| 201-3 | 10 | 17 | *phureja* BGRC15481 |
| 203-2 | 10 | 17 | *phureja* GLKS1455 |
| 220-2 | 10 | 17 | *stenotomum goniocalyx* GLKS2703 |
| 224-1 | 10 | 14 | *tarijense* BGRC18324 |
| 235-1 | 10 | 17 | *tuberosum andigena* GLKS5027 |
| 240-2 | 10 | 17 | *tuberosum andigena* CPC3121E |
| 243-1 | 10 | 17 | *tuberosum andigena* GLKS4737 |
| 246-3 | 10 | 12 | *tundalomense* GLKS2343 |
| 248-5 | 10 | 16 | *ugentii* GLKS2887 |
| 257-3 | 10 | 14 | *alandiae* BGRC10057 |
| 263-1 | 10 | 12 | *chacoense* CPC5901 |
| 270-1 | 10 | 14 | *gandarillasii* CPC7044 |
| 280-1 | 10 | 12 | *neocardenasii* CPC7208 |
| 280-4 | 10 | 12 | |
| 281-1 | 10 | 16 | *neorossii* CPC6047 |
| 281-2 | 10 | 16 | |
| 296-1 | 10 | 17 | *stenotomum* CPC4741 |
| 322-3 | 10 | 14 | *berthaultii* CGN20644 |
| 322-5 | 10 | 14 | *berthaultii* CGN20644 |
| 322-6 | 10 | 14 | *berthaultii* CGN20644 |
| 323-2 | 10 | 14 | *berthaultii* CGN20650 |
| 323-3 | 10 | 14 | *berthaultii* CGN20650 |
| 324-2 | 10 | 14 | *berthaultii* CGN18042 |
| 338-1 | 10 | 14 | *chacoense* CGN18248 |
| 338-2 | 10 | 14 | *chacoense* CGN18248 |
| 346-2 | 10 | 14 | *gandarillasii* CGN20560 |
| 347-2 | 10 | 13 | *gourlayi* CGN17851 |
| 347-9 | 10 | 13 | *gourlayi* CGN17851 |
| 351-8 | 10 | 16 | *hondelmannii* CGN18106 |
| 352-2 | 10 | 16 | *hondelmannii* CGN18182 |
| 352-6 | 10 | 16 | *hondelmannii* CGN18182 |
| 352-8 | 10 | 16 | *hondelmannii* CGN18182 |
| 357-5 | 10 | 16 | *leptophyes* CGN18140 |
| 357-6 | 10 | 16 | *leptophyes* CGN18140 |
| 356-8 | 10 | 16 | *leptophyes* CGN18174 |
| 371-1 | 10 | 17 | *phureja* CGN17667 |
| 371-7 | 10 | 17 | *phureja* CGN17667 |
| 372-8 | 10 | 17 | *phureja* CGN18301 |
| 381-4 | 10 | 16 | *raphanifolium* CGN17753 |
| 384-2 | 10 | 16 | *sparsipilum* CGN18154 |
| 384-5 | 10 | 16 | *sparsipilum* CGN18154 |
| 382-2 | 10 | 16 | *sparsipilum* CGN18225 |
| 382-5 | 10 | 16 | *sparsipilum* CGN18225 |
| 383-2 | 10 | 16 | *sparsipilum* CGN18230 |
| 383-3 | 10 | 16 | *sparsipilum* CGN18230 |
| 383-4 | 10 | 16 | *sparsipilum* CGN18230 |
| 383-5 | 10 | 16 | |
| 391-1 | 10 | 16 | *sucrense* CGN18205 |
| 391-3 | 10 | 16 | *sucrense* CGN18205 |
| 391-6 | 10 | 16 | *sucrense* CGN18205 |
| 392-1 | 10 | 12 | *tarijense* CGN17861 |
| 392-6 | 10 | 12 | *tarijense* CGN17861 |
| 392-8 | 10 | 12 | *tarijense* CGN17861 |
| 416-1 | 10 | 16 | species CGN20580 |
| 454-3 | 10 | 17 | *ajanhuiri* CGN22389 |
| 455-1 | 10 | 16 | *alandiae* CGN22349 |
| 457-5 | 10 | 14 | *alandiae* BGRC28490 |
| 458-1 | 10 | 14 | *alandiae* CGN20651 |
| 458-5 | 10 | 14 | *alandiae* CGN20651 |
| 470-1 | 10 | 17 | *andreanum* CGN17679 |
| 470-3 | 10 | 17 | *chacoense* CGN17679 |
| 471-1 | 10 | 12 | *arnezii* BGRC27309 |
| 472-3 | 10 | 16 | *astleyi* CGN18207 |
| 475-4 | 10 | 16 | *astleyi* CGN18211 |
| 475-22 | 10 | 16 | *astleyi* CGN18211 |
| 478-25 | 10 | 16 | *avilesii* CGN18256 |
| 477-1 | 10 | 16 | *avilesii* CGN18255 |
| 477-4 | 10 | 16 | *avilesii* CGN18255 |
| 477-5 | 10 | | *brevicaule* |
| 478-2 | 10 | 16 | *avilesii* CGN18256 |
| 494-3 | 10 | 14 | *berthaultii* CGN18118 |
| 481-3 | 10 | 14 | *berthaultii* CGN18190 |
| 483-1 | 10 | 14 | *berthaultii* CGN20636 |
| 483-3 | 10 | 14 | *berthaultii* CGN20636 |
| 486-2 | 10 | 14 | *berthaultii* CGN22716 |
| 486-3 | 10 | 14 | *berthaultii* CGN22716 |
| 487-1 | 10 | 14 | *berthaultii* CGN20645 |
| 487-8 | 10 | 14 | *berthaultii* CGN20645 |
| 488-1 | 10 | 14 | *berthaultii* CGN18246 |
| 488-2 | 10 | 14 | *berthaultii* CGN18246 |
| 489-1 | 10 | 14 | *berthaultii* BGRC28496 |
| 491-1 | 10 | 14 | *berthaultii* CGN22727 |
| 493-5 | 10 | 14 | *berthaultii* CGN17823 |
| 493-7 | 10 | 14 | *berthaultii* CGN17823 |
| 493-9 | 10 | 14 | |
| 496-1 | 10 | 16 | |

TABLE 7-continued

Genotypes screened for Rpi-chc1 related sequences. Taxonomic groups refer to regrouping of *Solanum* section petota by (Jacobs et al., 2008)

| GENOTYPE code | tree main group | tree sub group | species, accesssion nr |
|---|---|---|---|
| 505-4 | 10 | 16 | brevicaule CGN17841 |
| 509-1 | 10 | 16 | brevicaule CGN22321 |
| 509-2 | 10 | 16 | brevicaule CGN22321 |
| 544-11 | 10 | 14 | chacoense CGN18365 |
| 550-3 | 10 | 12 | chacoense BGRC24528 |
| 550-4 | 10 | 12 | chacoense BGRC24528 |
| 543-1 | 10 | 14 | chacoense BGRC63055 |
| 543-5 | 10 | 14 | |
| 545-1 | 10 | 12 | chacoense CGN17702 |
| 547-1 | 10 | 12 | |
| 548-1 | 10 | 12 | chacoense CGN18294 |
| 548-2 | 10 | 12 | chacoense CGN18294 |
| 544-1 | 10 | 14 | chacoense CGN18365 |
| 544-5 | 10 | 14 | |
| 561-2 | 10 | 14 | berthaultii BGRC55178 |
| 561-3 | 10 | 14 | chomatophilum BGRC55178 |
| 601-2 | 10 | 14 | species BGRC55186 |
| 605-1 | 10 | 13 | gourlayi CGN17591 |
| 606-1 | 10 | 13 | gourlayi CGN18039 |
| 608-1 | 10 | 13 | gourlayi BGRC17316 |
| 609-1 | 10 | 13 | gourlayi CGN17592 |
| 609-5 | 10 | 13 | gourlayi CGN17592 |
| 610-4 | 10 | 13 | gourlayi CGN22336 |
| 611-1 | 10 | 13 | gourlayi CGN21335 |
| 613-1 | 10 | 13 | gourlayi pachytrichum CGN18176 |
| 613-2 | 10 | 13 | gourlayi pachytrichum CGN18176 |
| 614-1 | 10 | 16 | gourlayi pachytrichum BGRC27294 |
| 616-2 | 10 | 13 | |
| 616-4 | 10 | 13 | gourlayi pachytrichum CGN18188 |
| 617-1 | 10 | 16 | gourlayi pachytrichum BGRC7231 |
| 618-1 | 10 | 16 | gourlayi pachytrichum BGRC28084 |
| 619-5 | 10 | 13 | gourlayi vidaurrei CGN17848 |
| 620-1 | 10 | 13 | gourlayi vidaurrei CGN17849 |
| 620-3 | 10 | 13 | gourlayi vidaurrei CGN17849 |
| 622-1 | 10 | 13 | gourlayi vidaurrei CGN17850 |
| 622-5 | 10 | 13 | gourlayi vidaurrei CGN17850 |
| 624-1 | 10 | 16 | gourlayi vidaurrei CGN17864 |
| 625-2 | 10 | 16 | gourlayi vidaurrei CGN23024 |
| 626-2 | 10 | 16 | gourlayi vidaurrei CGN23045 |
| 634-4 | 10 | 13 | hawkesianum CGN17888 |
| 635-3 | 10 | 13 | hawkesianum CGN17889 |
| 646-3 | 10 | 16 | hondelmannii CGN18192 |
| 646-4 | 10 | 16 | hondelmannii CGN18192 |
| 650-1 | 10 | 13 | hoopesii CGN18363 |
| 650-3 | 10 | 13 | hoopesii CGN18363 |
| 652-3 | 10 | 13 | hoopesii CGN18368 |
| 653-5 | 10 | 13 | hoopesii CGN18372 |
| 658-1 | 10 | 13 | incamayoense CGN21320 |
| 658-4 | 10 | 13 | incamayoense CGN21320 |
| 659-3 | 10 | 13 | incamayoense CGN17874 |
| 660-1 | 10 | 13 | incamayoense CGN17875 |
| 660-5 | 10 | 13 | incamayoense CGN17875 |
| 661-1 | 10 | 13 | incamayoense CGN17968 |
| 661-4 | 10 | 13 | incamayoense CGN17968 |
| 662-1 | 10 | 13 | incamayoense BGRC17334 |
| 664-1 | 10 | 13 | infundibuliforme CGN17720 |
| 664-4 | 10 | 13 | infundibuliforme CGN17720 |
| 665-4 | 10 | 16 | infundibuliforme CGN23063 |
| 666-1 | 10 | 16 | infundibuliforme CGN22334 |
| 666-4 | 10 | 16 | infundibuliforme CGN22334 |
| 667-4 | 10 | 13 | brevicaule |
| 682-5 | 10 | 16 | leptophyes CGN18167 |
| 683-5 | 10 | 16 | leptophyes CGN20611 |
| 735-1 | 10 | 16 | |
| 735-2 | 10 | 16 | neorossii CGN18280 |
| 735-4 | 10 | 16 | neorossii CGN18280 |
| 742-1 | 10 | 15 | okadae BGRC27158 |
| 747-1 | 10 | 16 | oplocense CGN23049 |
| 750-1 | 10 | 16 | oplocense CGN21352 |
| 750-2 | 10 | 16 | |
| 753-1 | 10 | 16 | oplocense CGN21319 |
| 754-2 | 10 | 16 | oplocense CGN17871 |
| 755-1 | 10 | 16 | oplocense CGN18086 |
| 802-1 | 10 | 12 | ruiz-lealii CGN18117 |
| 816-3 | 10 | 16 | sparsipilum CGN18096 |
| 816-5 | 10 | 16 | sparsipilum CGN18096 |
| 818-8 | 10 | 16 | sparsipilum CGN18221 |
| 819-2 | 10 | 16 | sparsipilum CGN20653 |
| 819-4 | 10 | 16 | sparsipilum CGN20653 |
| 821-1 | 10 | 16 | sparsipilum CGN20602 |
| 821-3 | 10 | 16 | sparsipilum CGN20602 |
| 821-4 | 10 | 16 | sparsipilum CGN20602 |
| 827-1 | 10 | 16 | spegazzinii CGN23015 |
| 829-3 | 10 | 17 | stenotomum CGN18161 |
| 829-9 | 10 | 17 | stenotomum CGN18161 |
| 843-4 | 10 | 16 | sucrense CGN20628 |
| 844-1 | 10 | 16 | sucrense CGN20630 |
| 844-3 | 10 | 16 | sucrense CGN20630 |
| 843-5 | 10 | 16 | sucrense CGN20628 |
| 844-7 | 10 | 16 | sucrense CGN20630 |
| 845-6 | 10 | 16 | sucrense CGN20631 |
| 846-1 | 10 | 16 | sucrense CGN18187 |
| 846-6 | 10 | 16 | sucrense CGN18187 |
| 849-1 | 10 | 16 | sucrense CGN18206 |
| 849-2 | 10 | 16 | sucrense CGN18206 |
| 849-6 | 10 | 16 | sucrense CGN18206 |
| 852-5 | 10 | 14 | tarijense CGN22729 |
| 853-4 | 10 | 14 | tarijense BGRC27348 |
| 855-8 | 10 | 14 | tarijense CGN18198 |
| 855-10 | 10 | 14 | tarijense CGN18198 |
| 856-5 | 10 | 14 | tarijense BGRC8232 |
| 859-3 | 10 | 14 | tarijense CGN17975 |
| 863-2 | 10 | 14 | tarijense BGRC18609 |
| 864-3 | 10 | 14 | tarijense BGRC18610 |
| 864-21 | 10 | 14 | tarijense BGRC18610 |
| 868-9 | 10 | 12 | tarijense CGN18107 |
| 869-3 | 10 | 12 | tarijense BGRC17022 |
| 870-3 | 10 | 14 | tarijense CGN17978 |
| 876-1 | 10 | 14 | tarijense BGRC17438 |
| 887-1 | 10 | 17 | tuberosum andigena CGN20614 |
| 891-1 | 10 | 16 | ugentii CGN18364 |
| 927-1 | 10 | 16 | virgultorum BGRC31203 |
| 928-1 | 10 | 16 | virgultorum CGN17775 |
| 928-3 | 10 | 16 | virgultorum CGN17775 |
| 987-3 | 10 | 16 | |

TABLE 8

Primers used in this study (SEQ ID NOS: 136-180, in order of appearance)

| primer code | Application | sequence | orientation | Tm |
|---|---|---|---|---|
| MN581 | Marker germplasm screen | GCGGAGAGTTTCGTGAATTG | F | 61 |
| MN582 | Marker germplasm screen | CCCACACATGTACAGGGAATG | R | 61 |
| MN585 | Marker germplasm screen | ACATCTCTCGTAAAGCTTAGAG | F | 55 |
| MN586 | Marker germplasm screen | ACAGATAATAATTTTCAACTGC | F | 55 |
| MN587 | Marker germplasm screen | ATTTGGGACATTCTGATATAAG | R | 55 |
| MN588 | Marker germplasm screen | CACTTTCATATTTGCTTATATC | F | 55 |
| MN589 | Marker germplasm screen | GACAATCACGTATCCACAGGAG | R | 55 |
| MN595 | Rpi-chc1 homolog mining | GGGGACAAGTTTGTACAAAAAAGCAGGCT<br>ATGAATTATTGTCTTCCTTCGAGTAC | F | |
| MN597 | Rpi-chc1 homolog mining | GGGGACCACTTTGTACAAGAAAGCTGGGT<br>TCAGAAAGTGAAAGAGAAACCGAG | R | |
| MN598 | Rpi-chc1 promoter construction | GGGGACAACTTTGTATAGAAAAGTTG<br>ACGCATCAGGAAGAGAGGAG | F | |
| MN599 | Rpi-chc1 promoter construction | GGGGACTGCTTTTTTGTACAAACTTG<br>ATACAATCATTCAAACAGTAAT | R | |
| MN600 | Rpi-chc1 terminator construction | GGGGACAGCTTTCTTGTACAAAGTGG<br>GTCGCTTGCATTTTTAATTAG | F | |
| MN601 | Rpi-chc1 terminator construction | GGGGACAACTTTGTATAATAAAGTTG<br>GCGGTTCCTCTGTGAAACAC | R | |
| MN670 | Rpi-chc1 promoter construction | GGGGACAACTTTGTATAGAAAAGTTG<br>TGATTTGTTTTTCCTATTCCTGAC | F | 59 |
| MN622 | Rpi-chc1 homolog sequencing | atgaattattgtcttccttc | | |
| MN623 | Rpi-chc1 homolog sequencing | acacaaaatgtatctttaatcc | | |
| MN624 | Rpi-chc1 homolog sequencing | agagttgacggctatcaataag | | |
| MN625 | Rpi-chc1 homolog sequencing | ttacaatgatgaacacatgaag | | |
| MN626 | Rpi-chc1 homolog sequencing | gaggaataaatacatccagagg | | |
| MN627 | Rpi-chc1 homolog sequencing | acaaagaaaaacatgaatggc | | |
| MN628 | Rpi-chc1 homolog sequencing | gaagacgttgggcacaggt | | |
| MN629 | Rpi-chc1 homolog sequencing | ttgtgcacactgttttggag | | |
| MN630 | Rpi-chc1 homolog sequencing | tgagatgagaaatatgataag | | |
| MN631 | Rpi-chc1 homolog sequencing | tgataaagaagaggctcaaac | | |
| MN632 | Rpi-chc1 homolog sequencing | gcaaagaaattccatcccttg | | |
| MN633 | Rpi-chc1 homolog sequencing | cagactgtccattgttaaaaag | | |
| MN634 | Rpi-chc1 homolog sequencing | aatctccattctcttaggag | | |
| MN635 | Rpi-chc1 homolog sequencing | atatcagaatgtcccaaattg | | |
| MN636 | Rpi-chc1 homolog sequencing | aattgaggctcttcctcctac | | |
| MN637 | Rpi-chc1 homolog sequencing | cctcactaaattatggaacatg | | |
| MN638 | Rpi-chc1 homolog sequencing | TGCAGGACGCATCAGGAAGAG | | |
| MN639 | Rpi-chc1 homolog sequencing | ATAAGCCACAATGCAAATATAT | | |
| MN640 | Rpi-chc1 homolog sequencing | ATTTAGTTACATTGTAACTATC | | |
| MN641 | Rpi-chc1 homolog sequencing | GAGAAAAACATTAAGTCATAC | | |
| MN642 | Rpi-chc1 homolog sequencing | TCTTTTAAATTTATTTTACTATAC | | |

TABLE 8-continued

Primers used in this study (SEQ ID NOS: 136-180, in order of appearance)

| primer code | Application | sequence | orientation | Tm |
|---|---|---|---|---|
| MN643 | Rpi-chc1 homolog sequencing | CAAAATATCTTTTAGTACTAC | | |
| MN644 | Rpi-chc1 homolog sequencing | TATGATGAATTCGTTTTGTTTG | | |
| MN645 | Rpi-chc1 homolog sequencing | CTCGAAATTTTATTAGTACC | | |
| MN646 | Rpi-chc1 homolog sequencing | TGATATATATTGGGCCCGTG | | |
| MN647 | Rpi-chc1 homolog sequencing | ATCTATAACTCACACCTCTC | | |
| MN648 | Rpi-chc1 homolog sequencing | TTGAATGATGGCTATGGCTTG | | |
| MN649 | Rpi-chc1 homolog sequencing | GTTTTTAAAATTCTGTATTGCG | | |
| MN650 | Rpi-chc1 homolog sequencing | TTATTATTGTGAAGTTAGAAG | | |
| MN651 | Rpi-chc1 promoter sequencing | AGTTTTATAGAGAGGCTCTG | | |
| MN652 | Rpi-chc1 promoter sequencing | AAGCGCGAATAAGTTCTCTTG | | |

TABLE 9

Functional analysis of newly identified Rpi-chc1 homologs.

| clone | genotype | RD12 Responsiveness | IPO-C Resistance | Activity group |
|---|---|---|---|---|
| J2 | 324-2 | N | S | 1 |
| J8 | 324-2 | R | R | 2 |
| I6 | 487-1 | N | r | 5 |
| F1 | 493-5 | N | S | 1 |
| G2 | 493-7 | N | S | 1 |
| G19 | 493-7 | r | r | 6 |
| G10 | 493-7 | N | S | 1 |
| G12 | 493-7 | N | S | 1 |
| G14 | 493-7 | nd | r | |
| H11 | 493-9 | N | S | 1 |
| H5 | 493-9 | r | R | 2 |
| C2 | 543-5 | N | r | 5 |
| K30 | 561-2 | N | r | 5 |
| K4 | 561-2 | R | R | 2 |
| M8 | 849-1 | r | r | 6 |
| E30 | 852-5 | N | S | 1 |
| E28 | 852-5 | R* | S | 3 |
| E14 | 852-5 | N | R | 4 |
| L4 | 94-2031 | R | R | 2 |

In the column with RD12 responsiveness R means responsive, N means Non responsive,
*means autoactivating, r means weak response.
In the column with IPO-C resistance, R means strong resistance, r means weak resistance, S means susceptible.

REFERENCES

Armstrong, M. R., Whisson, S. C., Pritchard, L., Bos, J. I. B., Venter, E., Avrova, A. O., Rehmany, A. P., BÃ¶hme, U., Brooks, K., Cherevach, I., Hamlin, N., White, B., Fraser, A., Lord, A., Quail, M. A., Churcher, C., Hall, N., Berriman, M., Huang, S., Kamoun, S., Beynon, J. L. and Birch, P. R. J. (2005) An ancestral oomycete locus contains late blight avirulence gene Avr3a, encoding a protein that is recognized in the host cytoplasm. *Proceedings of the National Academy of Sciences of the United States of America*, 102, 7766-7771.

Ballvora, A., Ercolano, M. R., Weiss, J., Meksem, K., Bormann, C. A., Oberhagemann, P., Salamini, F. and Gebhardt, C. (2002) The R1 gene for potato resistance to late blight (*Phytophthora infestans*) belongs to the leucine zipper/NBS/LRR class of plant resistance genes. *Plant J.*, 30, 361-371.

Bendahmane, A., Farnham, G., Moffett, P. and Baulcombe, D. C. (2002) Constitutive gain-of-function mutants in a nucleotide binding site-leucine rich repeat protein encoded at the Rx locus of potato. *Plant J.*, 32, 195-204.

Bradshaw, J. E., Bryan, G. J., Lees, A. K., McLean, K. and Solomon-Blackburn, R. M. (2006) Mapping the R10 and R11 genes for resistance to late blight (*Phytophthora infestans*) present in the potato (*Solanum tuberosum*) R-gene differentials of Black *Theor. Appl. Genet.*, 112, 744-751.

Brugmans, B., Wouters, D., van Os, H., Hutten, R. C. B., van der Linden, G., Visser, R. G. F., van Eck, H. J. and van der Vossen, E. A. G. (2008) Genetic mapping and transcription analyses of resistance gene loci in potato using NBS profiling. *Theor Appl Genet*, 117, 1379-1388.

Foster, S. J., Park, T. H., Pel, M., Brigneti, G., Sliwka, J., Jagger, L., van der Vossen, E. A. G. and Jones, J. D. (2009) Rpi-vnt1.1, a Tm-2(2) Homolog from *Solanum venturii*, Confers Resistance to Potato Late Blight. *Mol. Plant Microbe Interact.*, 22, 589-600.

Gao, H., Narayanan, N. N., Ellison, L. and Bhattacharyya, M. K. (2005) Two Classes of Highly Similar Coiled Coil-Nucleotide Binding-Leucine Rich Repeat Genes Isolated from the Rps1-k Locus Encode *Phytophthora* Resistance in Soybean. *Mol. Plant Microbe Interact.*, 18, 1035-1045.

Haas, B. J., Kamoun, S., Zody, M. C., Jiang, R. H., Handsaker, R. E., Cano, L. M., Grabherr, M., Kodira, C. D., Raffaele, S., Torto-Alalibo, T., Bozkurt, T. O., Ah-Fong, A. M., Alvarado, L., Anderson, V. L., Armstrong, M. R., Avrova, A., Baxter, L., Beynon, J., Boevink, P. C., Bollmann, S. R., Bos, J. I., Bulone, V., Cai, G., Cakir, C., Carrington, J. C., Chawner, M., Conti, L., Costanzo, S., Ewan, R., Fahlgren, N., Fischbach, M. A., Fugelstad, J., Gilroy, E. M., Gnerre, S., Green, P. J., Grenville-Briggs, L. J., Griffith, J., Grunwald, N. J., Horn, K., Horner, N. R., Hu, C. H., Huitema, E., Jeong, D. H., Jones, A. M., Jones, J. D., Jones, R. W., Karlsson, E. K., Kunjeti, S. G., Lamour, K., Liu, Z., Ma, L., Maclean, D., Chibucos, M. C., McDonald, H., McWalters, J., Meijer, H. J., Morgan, W., Morris, P. F., Munro, C. A., O'Neill, K., Ospina-Giraldo, M., Pinzon, A., Pritchard, L., Ramsahoye, B., Ren, Q., Restrepo, S., Roy, S., Sadanandom, A., Savidor, A., Schornack, S., Schwartz, D. C., Schumann, U. D., Schwessinger, B., Seyer, L., Sharpe, T., Silvar, C., Song, J., Studholme, D. J., Sykes, S., Thines, M., van de Vondervoort, P. J., Phuntumart, V., Wawra, S., Weide, R., Win, J., Young, C., Zhou, S., Fry, W., Meyers, B. C., van West, P., Ristaino, J., Govers, F., Birch, P. R., Whisson, S. C., Judelson, H. S. and Nusbaum, C. (2009) Genome sequence and analysis of the Irish potato famine pathogen *Phytophthora infestans*. *Nature*, 461, 393-398.

Huang, S., van der Vossen, E. A. G., Kuang, H., Vleeshouwers, V. G. A. A., Zhang, N., Borm, T. J., van Eck, H. J., Baker, B., Jacobsen, E. and Visser, R. G. F. (2005) Comparative genomics enabled the isolation of the R3a late blight resistance gene in potato. *Plant J.*, 42, 251-261.

Jacobs, M. M., van den Berg, R. G., Vleeshouwers, V. G., Visser, M., Mank, R., Sengers, M., Hoekstra, R. and Vosman, B. (2008) AFLP analysis reveals a lack of phylogenetic structure within Solanum section Petota. *BMC evolutionary biology*, 8, 145.

Jansky, S. (2000) Breeding for disease resistance in potato. *Plant Breeding Rev.*, 19, 69-155.

Jones, J. D. and Dangl, J. L. (2006) The plant immune system. *Nature*, 444, 323-329.

Joobeur, T., King, J. J., Nolin, S. J., Thomas, C. E. and Dean, R. A. (2004) The *Fusarium* wilt resistance locus Fom-2 of melon contains a single resistance gene with complex features. *Plant J.*, 39, 283-297.

Kuhl, J. C., Hanneman, R. E., Jr. and Havey, M. J. (2001) Characterization and mapping of Rpi1, a late-blight resistance locus from diploid (1EBN) Mexican *Solanum pinnatisectum*. *Mol. Genet. Genomics*, 265, 977-985.

Lokossou, A. A., Park, T. H., van Arkel, G., Arens, M., Ruyter-Spira, C., Morales, J., Whisson, S. C., Birch, P. R., Visser, R. G., Jacobsen, E. and van der Vossen, E. A. (2009) Exploiting knowledge of R/Avr genes to rapidly clone a new LZ-NBS-LRR family of late blight resistance genes from potato linkage group IV. *Mol. Plant Microbe Interact.*, 22, 630-641.

Moreau, P., Thoquet, P., Olivier, J., Laterrot, H. and Grimsley, N. (1998) Genetic Mapping of Ph-2, a Single Locus Controlling Partial Resistance to *Phytophthora infestans* in Tomato. *Mol. Plant Microbe Interact.*, 11, 259-269.

Park, T. H., Foster, S. J., Brigneti, G. and Jones, J. D. G. (2008) Two distinct potato late blight resistance genes from *Solanum berthaultii* are located on chromosome 10. *Euphytica*.

Park, T. H., Gros, J., Sikkema, A., Vleeshouwers, V. G. A. A., Muskens, M., Allefs, S., Jacobsen, E., Visser, R. G. F. and van der Vossen, E. A. G. (2005a) The late blight resistance locus Rpi-bib3 from *Solanum bulbocastanum* belongs to a major late blight R gene cluster on chromosome 4 of potato. *Mol. Plant Microbe Interact.*, 18, 722-729.

Park, T. H., Vleeshouwers, V. G. A. A., Huigen, D. J., van der Vossen, E. A. G., van Eck, H. J. and Visser, R. G. F. (2005b) Characterization and high-resolution mapping of a late blight resistance locus similar to R2 in potato. *TAG. Theoretical and applied genetics*, 111, 591-597.

Pel, M. A., Foster, S. J., Park, T. H., Rietman, H., van Arkel, G., Jones, J. D., Van Eck, H. J., Jacobsen, E., Visser, R. G. F. and Van der Vossen, E. A. G. (2009) Mapping and Cloning of Late Blight Resistance Genes from *Solanum venturii* Using an Interspecific Candidate Gene Approach. *Mol. Plant Microbe Interact.*, 22, 601-615.

Rauscher, G. M., Smart, C. D., Simko, I., Bonierbale, M., Mayton, H., Greenland, A. and Fry, W. E. (2006) Characterization and mapping of RPi-ber, a novel potato late blight resistance gene from *Solanum berthaultii*. *Theor. Appl. Genet.*, 112, 674-687.

Rouppe van der Voort, J. N. A. M., Kanyuka, K., van der Vossen, E. A. G., Bendahmane, A., Mooijman, P., Klein-Lankhorst, R. M., Stiekema, W. J., Baulcombe, D. C. and Bakker, J. (1999) Tight physical linkage of the nematode resistance gene Gpa2 and the virus resistance gene Rx on a single segment introgressed from the wild species *Solanum tuberosum* subsp. *andigena* CPC 1673 into cultivated potato. *Mol. Plant Microbe Interact.*, 12, 197-206.

Song, J., Bradeen, J. M., Naess, S. K., Raasch, J. A., Wielgus, S. M., Haberlach, G. T., Liu, J., Kuang, H., Austin-Phillips, S., Buell, C. R., Helgeson, J. P. and Jiang, J. (2003) Gene RB cloned from *Solanum bulbocastanum* confers broad spectrum resistance to potato late blight. *Proc. Natl. Acad. Sci. USA*, 100, 9128-9133.

Tameling, W. I., Vossen, J. H., Albrecht, M., Lengauer, T., Berden, J. A., Haring, M. A., Cornelissen, B. J. and Takken, F. L. (2006) Mutations in the NB-ARC domain of 1-2 that impair ATP hydrolysis cause autoactivation. *Plant Physiol.*, 140, 1233-1245.

Tan, M. Y., Hutten, R. C., Celis, C., Park, T. H., Niks, R. E., Visser, R. G. F. and van Eck, H. J. (2008) The R(Pi-mcd1) locus from *Solanum microdontum* involved in resistance to *Phytophthora infestans*, causing a delay in infection, maps on potato chromosome 4 in a cluster of NBS-LRR genes. *Mol. Plant Microbe Interact.*, 21, 909-918.

van der Biezen, E. A. and Jones, J. D. (1998) The NB-ARC domain: a novel signalling motif shared by plant resistance gene products and regulators of cell death in animals. *Curr. Biol.*, 8, R226-227.

van der Linden, C. G., Wouters, D. C., Mihalka, V., Kochieva, E. Z., Smulders, M. J. and Vosman, B. (2004) Efficient targeting of plant disease resistance loci using NBS profiling. *Theor. Appl. Genet.*, 109, 384-393.

van der Vossen, E. A. G., Sikkema, A., Hekkert, B. L., Gros, J., Stevens, P., Muskens, M., Wouters, D., Pereira, A., Stiekema, W. J. and Allefs, S. (2003) An ancient R gene from the wild potato species Solanum bulbocastanum confers broad-spectrum resistance to Phytophthora infestans in cultivated potato and tomato. *Plant J.*, 36, 867-882.

van Os, H., Andrzejewski, S., Bakker, E., Barrena, I., Bryan, G. J., Caromel, B., Ghareeb, B., Isidore, E., de Jong, W., van Koert, P., Lefebvre, V., Milbourne, D., Ritter, E., van der Voort, J. N. A. M., Rousselle-Bourgeois, F., van Vliet, J., Waugh, R., Visser, R. G. F., Bakker, J. and van Eck, H. J. (2006) Construction of a 10,000-marker ultradense genetic recombination map of potato: providing a framework for accelerated gene isolation and a genomewide physical map. *Genetics*, 173, 1075-1087.

Vleeshouwers, V. G. A. A., Rietman, H., Krenek, P., Champouret, N., Young, C., Oh, S. K., Wang, M., Bouwmeester, K., Vosman, B., Visser, R. G. F., Jacobsen, E., Govers, F., Kamoun, S. and Van der Vossen, E. A. G. (2008) Effector genomics accelerates discovery and functional profiling of potato disease resistance and *phytophthora infestans* avirulence genes. *PLoS ONE*, 3, e2875.

Vleeshouwers, V. G. A. A., van Dooijweert, W., Paul Keizer, L. C., Sijpkes, L., Govers, F. and Colon, L. T. (1999) A laboratory assay for *Phytophthora infestans* resistance in various *Solanum* species reflects the field situation. *Eur. J. Plant Pathol.,* 105, 241-250.

Wang, M., Allefs, S., van den Berg, R. G., Vleeshouwers, V. G. A. A., van der Vossen, E. A. G. and Vosman, B. (2008) Allele mining in Solanum: conserved homologues of Rpi-blb1 are identified in *Solanum stoloniferum. Theor. Appl. Genet.,* 116, 933-943.

SEQUENCE LISTING (225 sequences)

SEQ ID NO: 1 - DNA, 21 bp, Artificial
  primer
tgtttgatctcctcacccatc

SEQ ID NO: 2 - DNA, 20 bp, Artificial
  primer
gttcccctctctccctctcc

SEQ ID NO: 3 - DNA, 24 bp, Artificial
  primer
tgagaatttacagtggtttgttgc

SEQ ID NO: 4 - DNA, 24 bp, Artificial
  primer
gatcaatcaatcgatcataacgtc

SEQ ID NO: 5 - DNA, 20 bp, Artificial
  primer
cgaccccacccctcatcctt

SEQ ID NO: 6 - DNA, 21 bp, Artificial
  primer
cgccaacatattcgtgcttca

SEQ ID NO: 7 - DNA, 21 bp, Artificial
  primer
cgtgagctaagcatgaacacc

SEQ ID NO: 8 - DNA, 22 bp, Artificial
  primer
gcacgtttctcataatcccatc

SEQ ID NO: 9 - DNA, 23 bp, Artificial
  primer
atgtgactccgcatttgcagctc

SEQ ID NO: 10 - DNA, 28 bp, Artificial
  primer
atctcatcttattaatctgattcaaagc

SEQ ID NO: 11 - DNA, 22 bp, Artificial
  primer
gaacgcgaaagagtgctgatag

SEQ ID NO: 12 - DNA, 19 bp, Artificial
  primer
cccgctgcctatggagagt

SEQ ID NO: 13 - DNA, 22 bp, Artificial
  primer
gtgcattaccctgttattttgc

SEQ ID NO: 14 - DNA, 20 bp, Artificial
  primer
tgggtcttggaagacaggtg

SEQ ID NO: 15 - DNA, 23 bp, Artificial
  primer
ggccacgtattaacaattttgag

SEQ ID NO: 16 - DNA, 23 bp, Artificial
  primer
gcatagcaattgaaagcctaaac

SEQ ID NO: 17 - DNA, 20 bp, Artificial
  primer
tgtttgacatcctccagcag

SEQ ID NO: 18 - DNA, 20 bp, Artificial
  primer
ctcagcttgggctttgtttc

SEQ ID NO: 19 - DNA, 20 bp, Artificial
  primer
acattaaaggctgcccacag

SEQ ID NO: 20 - DNA, 21 bp, Artificial
  primer
gcagttcgacaattttacgtc

SEQ ID NO: 21 - DNA, 20 bp, Artificial
  primer
tcaaggtggcattcttcaac

SEQ ID NO: 22 - DNA, 20 bp, Artificial
  primer
aagcaaggactttgcgattc

SEQ ID NO: 23 - DNA, 20 bp, Artificial
  primer
ttgctttgagttgttgcctg

SEQ ID NO: 24 - DNA, 20 bp, Artificial
  primer
tatgcatcatcatcgcgaac

SEQ ID NO: 25 - DNA, 20 bp, Artificial
  primer
tgtttgatgcttgggtagtg

SEQ ID NO: 26 - DNA, 21 bp, Artificial
  primer
cagcgttgaacactcaaaatc

SEQ ID NO: 27 - DNA, 20 bp, Artificial
  primer
tggcctaaagttggctgttg

SEQ ID NO: 28 - DNA, 20 bp, Artificial
  primer
tccaaccaaaacatgagacg

SEQ ID NO: 29 - DNA, 20 bp, Artificial
  primer
ccccgaatgataagtccaac

SEQ ID NO: 30 - DNA, 23 bp, Artificial
  primer
tgaggcatagagaacaatctttg

SEQ ID NO: 31 - DNA, 20 bp, Artificial
  primer
ccccgaatgataagtccaac

SEQ ID NO: 32 - DNA, 23 bp, Artificial
  primer
tgaggcatagagaacaatctttg

SEQ ID NO: 33 - DNA, 31 bp, Artificial
  primer
tttctctactgtctggcttgcttggggatac

SEQ ID NO: 34 - DNA, 30 bp, Artificial
  primer
gagctgcttctttggactttcttctgacct

SEQ ID NO: 35 - DNA, 20 bp, Artificial
  primer
aaaattgctgccaaagaagc

SEQ ID NO: 36 - DNA, 20 bp, Artificial
  primer
agtccgatacgccaacctac

SEQ ID NO: 37 - DNA, 22 bp, Artificial
  primer
tctttgctagtcgttggttgag

SEQ ID NO: 38 - DNA, 20 bp, Artificial
  primer
tgggtttcccaagttgaaag

SEQ ID NO: 39 - DNA, 21 bp, Artificial
  primer
gactctgccgtgattgctgaa

SEQ ID NO: 40 - DNA, 19 bp, Artificial
  primer
caccgggaagacgctgttt

SEQ ID NO: 41 - DNA, 20 bp, Artificial
  primer
acttgggaaacccaggagag

SEQ ID NO: 42 - DNA, 20 bp, Artificial
  primer
tttatggtcctgggtcttgg

SEQ ID NO: 43 - DNA, 25 bp, Artificial
  primer
gatgcatatcatcaaattcaatctc

SEQ ID NO: 44 - DNA, 19 bp, Artificial
  primer
ctccggtgttatcgacgtg

SEQ ID NO: 45 - DNA, 20 bp, Artificial
  primer
catgcctttttcttgggatg

SEQ ID NO: 46 - DNA, 20 bp, Artificial
  primer
tggaacccctttaactgtgc

SEQ ID NO: 47 - DNA, 17 bp, Artificial
  primer
tccaattgccagacgaa

SEQ ID NO: 48 - DNA, 22 bp, Artificial
  primer
tagagaaggcccttgtaagttt

SEQ ID NO: 49 - DNA, 20 bp, Artificial
  primer
ctgcatcaactggatattcc

SEQ ID NO: 50 - DNA, 19 bp, Artificial
  primer
gttgagcagtgcaatgtac

SEQ ID NO: 51 - DNA, 23 bp, Artificial
  primer
aggcgcttcttattatctttctc

SEQ ID NO: 52 - DNA, 24 bp, Artificial
  primer
accacaagcaatcatttctacacc

SEQ ID NO: 53 - DNA, 26 bp, Artificial
  primer
ctaatycaactytggatggcwgaagg

SEQ ID NO: 54 - DNA, 21 bp, Artificial
  primer
actcgattctcaacccgaaag

SEQ ID NO: 55 - DNA, 24 bp, Artificial
  primer
ctaccamkycgasaracagattcc

SEQ ID NO: 56 - DNA, 25 bp, Artificial
  primer
tggmckragaaamccttcwgccatc

SEQ ID NO: 57 - DNA, 23 bp, Artificial
  primer
ccwarrccwsccatwccyactat

SEQ ID NO: 58 - DNA, 21 bp, Artificial
  primer
catgagaaatgaacccctcac

SEQ ID NO: 59 - DNA, 21 bp, Artificial
  primer
aacgtgcagaggtatttttgg

SEQ ID NO: 60 - DNA, 23 bp, Artificial
  primer
ttttccacaagaatagccaagac

SEQ ID NO: 61 - DNA, 19 bp, Artificial
  primer
atctgggctcatccgaatc

SEQ ID NO: 62 - DNA, 20 bp, Artificial
  primer
ggccattgtttgtgaaactg

SEQ ID NO: 63 - DNA, 20 bp, Artificial
  primer
cgtcgggaagtctacattgc

SEQ ID NO: 64 - DNA, 20 bp, Artificial
  primer
tagggggtgtcaaaatgagc

SEQ ID NO: 65 - DNA, 22 bp, Artificial
  primer
gctggaacttcacagtaaaacc

SEQ ID NO: 66 - DNA, 25 bp, Artificial
  primer
gatgcatatcatcaaattcaatctc

SEQ ID NO: 67 - DNA, 19 bp, Artificial
  primer
ctccggtgttatcgacgtg

SEQ ID NO: 68 - DNA, 20 bp, Artificial
  primer
tcaaggtggcattcttcaac

SEQ ID NO: 69 - DNA, 20 bp, Artificial
  primer
aagcaaggactttgcgattc

SEQ ID NO: 70 - DNA, 19 bp, Artificial
  primer
ctaagggttcctccgcaag

SEQ ID NO: 71 - DNA, 20 bp, Artificial
  primer
caaattggaccgaacctttg

SEQ ID NO: 72 - DNA, 20 bp, Artificial
  primer
cccgagatccagtgaaattg

SEQ ID NO: 73 - DNA, 24 bp, Artificial
  primer
ggttctgaactcatcctattcctc

SEQ ID NO: 74 - DNA, 20 bp, Artificial
  primer
tagggggtgtcaaaatgagc

SEQ ID NO: 75 - DNA, 20 bp, Artificial
  primer
atggcaaaacggagttaggg

SEQ ID NO: 76 - DNA, 21 bp, Artificial
  primer
ttgtgtacattctatcccccg

SEQ ID NO: 77 - DNA, 18 bp, Artificial
  primer
tggcgtatgcatcaatgg

SEQ ID NO: 78 - DNA, 20 bp, Artificial
  primer
ccccgaatgataagtccaac

SEQ ID NO: 79 - DNA, 23 bp, Artificial
  primer
tgaggcatagagaacaatctttg

SEQ ID NO: 80 - DNA, 21 bp, Artificial
  primer
cgtgagctaagcatgaacacc

SEQ ID NO: 81 - DNA, 22 bp, Artificial
  primer
gcacgtttctcataatcccatc

SEQ ID NO: 82 - DNA, 20 bp, Artificial
  primer
cgaccccacccctcatcctt

SEQ ID NO: 83 - DNA, 21 bp, Artificial
  primer
cgccaacatattcgtgcttca

SEQ ID NO: 84 - DNA, 20 bp, Artificial
  primer
aaaattgctgccaaagaagc

SEQ ID NO: 85 - DNA, 20 bp, Artificial
  primer
agtccgatacgccaacctac

SEQ ID NO: 86 - DNA, 23 bp, Artificial
  primer
cgaactctgagattgggactatg

SEQ ID NO: 87 - DNA, 26 bp, Artificial
  primer
cacgaatagaacaataatagaaaaag

SEQ ID NO: 88 - DNA, 26 bp, Artificial
  primer
cacgaatagaacaataatagaaaaag

SEQ ID NO: 89 - DNA, 21 bp, Artificial
  primer
aacgtgcagaggtatttttgg

SEQ ID NO: 90 - DNA, 23 bp, Artificial
  primer
ttttccacaagaatagccaagac

SEQ ID NO: 91 - DNA, 19 bp, Artificial
  primer
atctgggctcatccgaatc

SEQ ID NO: 92 - DNA, 20 bp, Artificial
  primer
tagggggtgtcaaaatgagc

SEQ ID NO: 93 - DNA, 22 bp, Artificial
  primer
gctggaacttcacagtaaaacc

SEQ ID NO: 94 - DNA, 25 bp, Artificial
  primer
gatgcatatcatcaaattcaatctc

SEQ ID NO: 95 - DNA, 19 bp, Artificial
  primer
ctccggtgttatcgacgtg

SEQ ID NO: 96 - DNA, 24 bp, Artificial
  primer
ctacaaatgataaataagcaaact

SEQ ID NO: 97 - DNA, 18 bp, Artificial
  primer
aataggtggagggaggac

SEQ ID NO: 98 - DNA, 19 bp, Artificial
  primer
gaagcaaacatcaataata

SEQ ID NO: 99 - DNA, 17 bp, Artificial
  primer
ttcccctcaaatcatag

SEQ ID NO: 100 - DNA, 22 bp, Artificial
  primer
ccgatttactattggttcatgc

SEQ ID NO: 101 - DNA, 20 bp, Artificial
  primer
tcaaatttcgattggcttgc

SEQ ID NO: 102 - DNA, 20 bp, Artificial
  primer
tgtttgacatcctccagcag

SEQ ID NO: 103 - DNA, 20 bp, Artificial
  primer
ctcagcttgggctttgtttc

SEQ ID NO: 104 - DNA, 34 bp, Artificial
  primer
tgaccctgcaggggaccccttaacaagtgatgtg

SEQ ID NO: 105 - DNA, 33 bp, Artificial
  primer
tgacggcgcgccaaaaagtcccgctttgatacc

SEQ ID NO: 106 - DNA, 34 bp, Artificial
  primer
tgaccctgcaggccccttaacaagtgatgtgatg

SEQ ID NO: 107 - DNA, 34 bp, Artificial
  primer
tgacggcgcgcctcaggttcccttacaagattcc

SEQ ID NO: 108 - DNA, 32 bp, Artificial
  primer
tgaccctgcaggacgcatcaggaagagaggag

SEQ ID NO: 109 - DNA, 32 bp, Artificial
  primer
tgacggcgcgccgcggttcctctgtgaaacac

SEQ ID NO: 110 - protein, 1302 aa, Solanum chacoense
MNYCLPSSTLQTTTKRRLTLRRLCCKQLRKKTLVQTAEEEEANTTMADPVIGATVQVLLEKLISLTIEEVNSSRDFNKDLEMLTQNVSLIQAFIHDVETPQEKQQSVEQWLNRLERVAEDAQNVFDRFIYESLKTKVVRSPLKKVSGFFSHTAFKRKMSQKINNINKELTAINKVAKDLGLQSLMVPSRKILPIRETDSFVVASDIVGRDLDIAEIKEKILNMREEDIVLSTIPIVGMGGLGKTTVAKRIYNDEHMKQIFEKRIWLCLPEMSETKSFLEQILESLIERKIEVERRDIIVKKLQDELGGKKYLLVLDDLWCVDSTSWHEFIDTLRGINTSRGNCILVTTRRKQVASTVATDLHILGKLTEDHCWSIFKQKAFVDGRVPEELASMGNKIVKMCQGLPLAASVLGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVLLDEHNNITHCKMHDLVHDLAGDILKSRLFDPKGDNGEKLSQVRYFGCESPTDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEAQTAYLHDKPNICKLAYLWSHDESEGCEINDEHVLDGLQPHPNLKTLAVVDYLGTKFPSWFSEESLPNLVKLKLSGSKRCKEIPSLGQLKFLRHLELIGFHELECIGPAFYGVEMRNIGSNSIIQVFPSLKKLVLKDMRSLIEWKGDEVGVRMSPGLEKLRITDCPLLKSIPNQFEILRQLKITGVDSEMPLLNLCSNLTSLVKLRVYDMKELTCLPDEMLRNNVSLQQIIIFNCGEFRELPQSLYNLHSLRRLDIYNCTNFSSLPVPNGDNYLTSLEFFCLHNCNGLISIPIGMLDQCRLVFLNVSCCNNLVSFPVHVWEMPSLSYLLISECPKLISVPKVGLHHLTGLVRLGIGPFSEMVDFDAFQLIFNGIQQLLSLRDLEVYGRGHWDSLPYQLMQLSDLREITIADFGIEALPPTLDNLTSLESLTLVRCKQLQHLNFSDAMPKLRLLWIRDCPLLEALSDGLGNLVSLEELYLHDCEKLEHLPSRDAMRRLTKLWNMRIKGCPKLEESFTNYSQWSKISHISNIELGGWRRTAISLGFSFTF

SEQ ID NO: 111 - protein, 1255 aa, Solanum tuberosum
MADPVFAATVKVLLDKLISLTIKEISSSRDFNEDLEMLTHNVSLIQAFLHDVETPQVEKQQSVEQWLRRLERVAENAENVFDRFRYESLKTKVINIRNSPMKKVSGFFSHTAFKSKMSRKINSINKELTAINKVAKDLGLHSLIVPSRKILPIRETDSIVVASDVVGRDLDVAEIKEKILKMREEDVVMCTIPIVGMGGLGKTTVAKRIYNDEHIKQIFERRIWLCLPEMSETKSFLEQILESLTERKVEVQRRDIIVKKLQDKLGGKNYLLVLDDLWCVDSTSWHEFVDTLRGINTAKGNCILVTTRMKRVASTVAADLHMLGKLTEDHCWSIFEQKAFVDGRVPEELASMGNKIVKMCHGLPLAASVLGGLLHNKEKHEWQAILDGSPLVAGEDDNGENSIKKILKLSYDYLPSPHLKKCFAYFAMLPKDLMFEKAQLIQLWMAEGFLHPCQETTVMEDIGNNFFQLLLRNSLLQDVVLDEHNNIKYCKMHDLVHDLAGDIFKSKIFDSKGNDGEKLSQVRYFGWDSPSDQIDKINEPGRLCTLFWRNNYISEDMLLSFKFLRVLNLSRSGIKELSASIGKLIYLRYLDISSTEITALPHSICKLYNLQTFRANCCYSLKEFPYEMGNMISLRHIYFYSSSQMPLNLGQLTCLQTLQYFNVGLEKGHRIEELGCLNNLRGELSINELELVRSREDALTAYLQEKSNIYKLTYLWSHQESEGCEINAEHVLDGLQPHPYLKTFEVVRYLGTRFPSWFNEESLPNLVKLKLSNCSSCKEIPSLGQLKFLQHLELVGFHKLECIGTTFYGIEVNNMGSSSNNAIIQVFLSLKELVLENMRSLIEWKGVELIPTTSGVKMFPVLEKLRIRYCPLLKSTPKQLEILRELSIERVDSEMPLLNLCSNLTSLVKFSVSFVKELTCFPDEMLRSNVSLQHLSVYNCREFRELPQSLYNLHSLKSLMIEYCTNFSSFPVPSGENYLTSLQNLQLWSCGGLASLPSGMLEKCRSLQNLRVNYCNNLVSFPLHVGDMPSLSYLSIAHCPKLDSVPTGGLHHLTRLRELEIGPVSDMVDFEAFQLTFNGIQQLLSLRTLLVFGHLHWDSLPYQLMQLSALTHIHICDFGIEALPHRLDNLTSLEILHLVRCKWLQHVDFSDAMPKLRYLRICDCPLLEALSDAFCNLVSLEELRLENCEKLEHLPSREAMRRLTKLWYLKIKGCPKLEESCNNRSGPNTQWSNISHIPKVKVGGSIIQDLHKSHF

SEQ ID NO: 112 - protein, 1119 aa, Solanum tuberosum
MADPVIGATVQVVLEKLLSLTIEEARNVRNCKKNLRMLSRYVTMIQAFIHDAERRQVEDRAVEEWLKMLERIAEDAENVFDKFTYESIKAKVMNNRAKLMEKVSHFFSHTAFKYKMSRKINKINEELRDINQLANNLGLQSLTAPSRKILQIRETDSAVVPSDVVGRDKDVAVIKEKILNMRKDAVLCTIPIVGMGGLGKTTLAKRIFNDQHIEKHFENRIWLCLPEMSEIKNFLELILESLTERKVEVQSRDIIVKKLRAALGEKQYLLVLDDLWRADSTSWHEFLDTLRGINTSRGNCILVTTRSKQVASIVAEDLHKLGKLTDDHCWSIFKQRAFVDGEVPEEILSVENKIVEMCQGLPLAASVLGGLFCNKEKHEWQAILDGSSLVASEDSIKNILKLSYDYLPSPHLKKCFSYFAIFPKDFEFEKDQLIQLWMAEGFLRPCQETPVMEDVGNKFFQLLLQYSLLQDVNLDKYNNTTHCKMHDLVHDLAGDIFKSKLFDQKSVGGESLSQVRYFGWESPSDQIDKIYEPGRLCTLFWRSNHISEAMLLSFKFLRVLNLSSSGIKELPAKIGKLIYLRYLDLSNTKITALPNSICKLYNLQTLRFYSIWYPLGKLPEEMANMISLRHICCYHFFESDSQMPLNMGQLTSLQTLQFFYVGLKKGRRIEELGCLKNLRGELTIKRLQLVGNKEEARTAYLQEKPNIYKLVYSWSHDESEGCEINHEHVLDGLQPHPNLKTLEVVDYLGTKFASWFSEKMLPNLVMLRLRGCKRCKEIPSLGQLKSLRHLELIGFLELECIGPTFYGVDVNNNGSSSNIQVFPSLKELELNNMSSLIEWKGDEVGVRMFPRLEKLTIRNCPLLKSTPNQFEILSELVIVRVDSEMPLLNLCSNLPSLVELEVDDMKELTCLPDEMLRNNVSLQHISVSDCREFHELPQSLYNLHSLKRLTIDNCTNFSSFPVPSEENYLTSLQELRLLDCDGLSSLPSGMLEHCRSLETLSVSCCDNLVSFPLHVGEMPSLSYLYISQCPKLISLPSGGIHHLTELSELEIGPFSEMVDFEAFQLIFNGIQQLLSLRTLWVYGHGHWDSLPYQFMQLSGLTSESRLFLIDLATLLLLER

SEQ ID NO: 113 - protein, 1195 aa, Solanum tuberosum
MADPVIGATVQVLLEKLISLTIEEVNSSRDFNKDLEMLTQNASLIQAFIHDVETPQVEKQQSVEQWLYRLERVAEDAQNVFDRFRYESLKTKVRSIRNSPMKKVSGFFSHTAFKRKMSQKINNINKELTAINKVAKDLGLQSLMVPSRKILPIRETDSLVVASDVVGRDMDVAEIKEKILKMREEDAVLCTIPIVGMGGLGKTTVAKRIYNDEHIKQIFEKRIWLCLPEMSEIMIFLEQILESLTEKKVEVQRRDIIVKKLQDELGGKNYLLVLDDLWRLDSTSWHEFVDTLRGINTSRGNCILVTTRMKRVASTIATNLHILGKLTEDHCWSIFKQKAFVDGRVPEEFASMGNKIVKMCEGLPLAASVLGGLLCNKEKHEWQALLDGNPLIVGEDDNGENNIKKILKLSYDYLPSPYLKKCFAYFAMFPKDFKFEKDQLIQLWMAEGFLHPCQETTVMEDIGNNFFRLLLRNSLLQDVVLDEHNNIKYCKMHDLVHDLAGDILKSKLFDRKGNDGEKLSQVRYCGWDSPSDQIGKINEPGRLCTLFWRSNYISEDMLLSFKFLRVLNLSSSGIFGLSDKIGKLIYLRYLDISSTEITALPHSICKLYNLQTFRVNYCYSLKEFPYEMGNMISLRHIYFYSSSQMPLNLGQLTCLQTLQYFNVGLEKGRRIEELGRLKNLRGKLRINGLQLVRDREEARTACLREKLNIYKLAYLWSHEESEGCEINDEHVLDGLQPHPNLKTFEVKNYLGTRFPSWFSEESLPNLVKLKLSGCKRCKEIPSLGQLKFLRHLELVGFHKVECIGTIFYGIEVNNKGSSSNNGNIQVFPLLKELVLEDMHSLIEWKGVELIPTNGVRMFPGLEKLKISNCPLLKSIPNQFEILRELEIRVVDSEMPLLNLFNNLTSLLELRVYDVKELTCLPDEMLRNNLSLQHLSVSYCGEFRELPQSLYNLHSLKSLRIDNCTNFNFFPVPKGENYLTSLQSLELCYCDGLTSLPSGLLEHCRSLESLKVHNCNNLVSFPLHVCGMPSLSYLGLSQCPKLISVPSGGLHHLTRLRESHIGPFSEMVDFEAFQLMFNGIHQLSSLRTLEVWGHLHWDSLPYQLMQLSALKEIRIYGFGIEALPHRFGNLTSLERLHLVGCNRLQHVDFSDDMPKLQLLWIQDCLLLEDLSNGLGNLVTLQQLTLWNSKKLEHLPC

SEQ ID NO: 114 - protein, 986 aa, Solanum tuberosum
MADPVIGATVQVVLEKLLSLTIEEARNLRNCKKNLRMLSRYVTMIQAFIHDAERRQVEDKAVEEWLKMLERIAEDAENVFDKFTYESIKAKVMNNRAKLMEKVSHLFSHTAFKYKMSRKINKINEELRDINQLANNLGLQSLTVPSRKILQIRETDSAVVPSDVVGRDKDVAEIKGKILNMRKDAVLCTIPIVGMGGLGKTTLAKRIFNDQHIEKHFEKRIWLCIPEMSEIKSFLELILESLTERKVEVQSRDIIVKKLRDALGEKQYLLVLDDLWRVDSTSWHEFLDTLRGINTSRGNCILVTTRSKQVASIVAADLHKLGKLTDDHCWSIFKQRAFVDGEVPEEILSVENKIVEMCQGLPLAASVLGGLFCNKEKHEWQAILDGSSLVASEDSIKNILKLSYDYLPSPHLKKCFSYFAMFSKDFKFEKDQLIQLWMAEGFLRPCQETTVMEDVGNKFFQLLLQYSLLQDVNLDEYNNITHCKMHDLVHDLAHDIFKSKLFEQKSVGGENLSQVRYFGWESPSDQIDKIYEPGRLCTLFWKSNISDDMLLSFQFLRVLNLSGSDIKELSASIVKLIYLRYLDLSNTKMNDRYLDLSNTKMNDLPNSICKLYNLQTLRFYCWYPLRKLPEEMANMISLRHICCYQFFESDFQMPLNMGQLTSLQTLPFFYVGSEKGRRIEELGCLKNLRGELTIERLQLVGNKEEARTAYLQEKPNIYKLVYSWSHDEPEGCEINHEHVLDGLQPHPNLKTLEVVDYLGTKFASWFSEKMLPNLVMLRLSGCKRCKEIPSLGQLKSLRHLQLIGFLELECIGPTFYGVDVNNNGSSSNIQVFPSLKELELNNMSSLIEWKGDEVGVRMFPRLEKLTISNCPLLKSTPNQFEILSELVIARVDSEMPLLNLCINLPSLVELGVYDIKELTCLPDEMLRNNVSLQRLMVSGCGEFRELPQSVYNLHSLKRLTIERCTNFSSFPVPSEENYLTSLQDLR

SEQ ID NO: 115 - protein, 1553 aa, Solanum tuberosum
MADPVIGATVQVVLEKLLSLTIEEARSLRNCKKNLRMLSRYVTMIQAFIHDAERRQVEEWLKMLERIAEDAENVFDKFTYESIKAKVMNNRAKLMEKVSHFFSHTAFKYKMSRKINKINEELRDINQLANNLGLQSLTVPSRKILQIRETDSAVVPSDVVGRDKDVAEIKEKILNMRKDAVLCTIPIVGMGGLGKTTLAKRIFNDQHIEKHFEKRIWLCLPEMSEIKSFLELILESLTERKVEVQSRDIIVKKLRDALGEKQYFLVLDDLWRVDYTLWHEFLDTLRGINTSRGNCILVTTRSKQVASIVAADLHKLGKLTDDQCWSIFKQRAFVDGEVPEEILSVENKIVEMCQGLPLAASVLGGLFCNKEKHEWQAILDGSSLVASEDSIKNILKLSYDYLPSPHLKKCFSYFAMFPKDFKFEKDQLIQLWMAEGTDSVVVASDVVGRDKDVAEIKEKILTMRDDIDLCTIPIVGMGGLGKTTVAKRVFNDEQIEKHFEKRVWLCLPEMSETKSFLELILESLTERKLEVQSRDIIVKKLRDELAGRKYLLVLDDLWRVDPTLWHEFLDTLKGINTTRGNCILVTTRMKLVASTVAVGLHMLGKLADDHCWSIFKQRAFVDGEVPEEMVIMENRIVETCQGLPLAAGVLGGLIRNKEKHEWQAILDSNSLVAHEDDLGENSIKKILKLSYVYLPSPHLKKCFAYFAMFPKDFEFEKDQLIQLWMAEGFLRPCQETTVMEDVGNKFFQLLLQYSLLQDVNLDEYNNITHCKMHDLVHDLAGDIFKSKLFDQKSVGGENLSQVRYFGWESPSDQIDKIYEPGRLCTLFWKSNISDDMLLSFQFLRVLNLSGSDIKELSASIVKLIYLRYLDLSNTKMNDGYLDLSNTEMNDLPNSICKLYNLQTLRFYSSWYPLRKLPEEMANMISLRHICCYHFFESDFQMPLNMGQLTSLQTLPFFYVGSEKGRRIEELGCLKNLRGELTIERLQLVGNKEEARTAYLQEKPNIYKLVYSWSHDEPEGCEINHEHVLDGLQPHPNLKTLEVVDYLGTKFASWFSEKMLSNLVMLRLSGCKRCKEIPSLGQLKSLRHLQLIGFLELECIGPTFYGVDVNNNGSSSNIQVFPSLKELELNNMSSLIEWKGDEVGVRMFPRLEKLTISNCPLLKSTPNQFEILRELEIVMVDSEMPLLNLCSNLTSLVGLSVHDIKELTCFPDEMLRNKVSLQNLVVSGCGEFHELPQSLYNLHSLKTLKITRCANFNSFPVPSGENYLTSLQHLQLRDCEGLSSLPSGMLEHCRSLETLSVSCCDNLVSFPLHVGEMPSLSYLNISRCPKLISLPSGGIDHLTELSELKIGPFSEMVDFEAFQLIFNGIQQLLSLRTLTVYGHGHWDSLPYQFMQLSGLTAIHICGFGIEALPHRFGNLTSLETLMLLRCKRLQNLDFSYVMPKLQYLFVYESPLLEALSDGLGNLVTLELLHLENCEKLEYLPSRDTMRHLKKLQSLQINGCPKLEESCTNRSGPNSQWSNISHIQRIEVGRIPLYQCLSKSLFLFQFPSRIF

SEQ ID NO: 116 - protein, 985 aa, Solanum tuberosum
MADPVIGATVQVVLEKLLSLTIEEVKRLGNCKKDLEMLTKNVSLIQAFIHDAERRQVEDQVVEQWLKMLERVTENAENVFDEFRYESLKRQVKIRNNPMKKVSDFFSHTDFKRRMSRKINNINEELRAINKLANDLGLQSLMVPPRQILPIREFLHPCQETIVMEDVGHKFFQILLQNSLLQDVKLDEHNVITHGKMHDLVHDLAGDILKSKLFDPKGDVGEISSQVRYFGSDSPIDQIDKINEPGRLCALFSRSNIPNDVLFSFQFLRVLNLSRSGIKELSASIGKLVHLRYLDLSYSGIKALPNSICKLYSMQTLRVSKCFLLKELPDEMANMISLRHVYYNSLCMDNKHFQMPFNMGKLTCLQTLQFFKVGSEKGRRIEEIGHLKNLRGELTIEGLQLVCNREEARTAYLQEKPKIYKLKYVWSHDEPEGCETSDEYVLDGLQPHPNLKTLAVVEYMGTRFPSWFSEEFLPNLVRLKLSGCKRCKGIPSLGQLKFLQHLELVGFHKVEYIEPTFYGNDNGSSRNNTNIQVFPLLKELLLEDMPSLTEWKEVQLLPKGNVGRDRLGVRMFPVLKKLTIRNCPLLKSTPNQFEILRELSIEGVDSEIPLLNLCSNLTSLVMLIIRDVKQLTCLTDEILRNNFSLQHLLVLNCGEFRELPQSLYNLRSLKSLSIGDCTNFSSIPVSRGENHLTSLLKLRLYNCDGLTSLSSGLLEHCRSLESLNVNKCNNLVSLPLHVWGMPSLSYLNISKCPKLESVPAGSLHRLTGLRTLHTGPFSELVDFEAFQLIFNGIQQLSSLCVLWVYGHAHWDSLPYQLLEFSSVTEIGITDFGIKAFPIETLELVSCKQLQHLLINDCPYLEALSDGLSNLVSLVELSLSNCKNLQHLPSRDAMRRLTKLRRLNIKGCPQLEESCTNRSGPNSQWSKISHIPQISVEFTTIQDLRKFLFLFSFQSFSFNPLELFDTFEIFTPLKMCFNHQSLYSLS

SEQ ID NO: 117 - protein, 1335 aa, Solanum tuberosum
MADPVIGATVQVLLEKLISLTIEEVNSSRDFNKDLEMLTQFDKQQSVEQWLNRLERVAEDAQNVFDRFRYESLKTKVMSSPMKKVSGFFSHTAFKRKISRKINNINKEVTAINKVAKDLGLQSPMVPSRKILPIRETDSLVVASDVVGRDLDVAVIKEKILNMRKEDVVLSTIPIVGMGGLGKTTMAKRIYNDEHIKQAFEKRIWLCLPEMSETKSFLEQILESLTERKFEVERRDIIVKKLQDELGGKKYLLVLDDLWHVDFTSWHEFVDTLRGINTSRGNCILVTTRMKRVASTVATDLHMLGKLTEDHCWSIFKQKAFVDGRVPEELASMGNKIVEMCQGLPLAASVLGGLLHNKEKHEWQAILDGNPLVAGEDDKGENSIKKILTLSYVYLPSVQLKKCFAYFAMFPKDSEFEKEQLIQLWMAEGFLHPCQETTVMEDVGHRFFQILLQNSLLQDIKLDELNNITHCKVHDLVHDLAGDILKSKLFDPKGDDGEKLSQVRYFGCESPRNQIDKIYEPQRLCTLFWRSNSISEDMLLSFKFLRALNLSSSGIKELSAKIGKLIYLRYLDLSNTKITALPNSICKLYNLQTFRVINCHSLKELPYEMGNMISLRHIYYTSADETNGHLGEWCIRNEHFQMPLKMRQLTCLQTLQFFKVGVAKGRQIEELGHLKNLRGELTINGLQLVGDREEARTANLQEKSNIYKLAFVWSHDEEEGSETNDEYVLDGLQPHPNLKTLAVVGYLGTKFPSWFREDLLPNLVKLKLSGCKRCKEIPSLGQLKLLRHLELSKLHKVECIGPKFYGKNIGSNSNIQVFPSLKELVLKSMSSLIEWKGDEVGVRMFPRLEKLTITECPLLKSTPSQFEILRELEIVIVDSEMPLLNLCSNLTSLVELRVSDMKELTCLPDEILRNNVSLQHLSVFDCEEFRELPQSLYNLHSLKTLRISNCANFSSFPVPSGENYLTSLQSLQLFDCDGLTSLPSGVLEHCRSLESLVVIYCNNLLSLPLHVWEMPSLSYLGLSGCPKLISVPSGGLHRLTGLRALEIGPFSEMVDFEAFQLIFNGIQQLLSLHNVGVTGRGHWDSLPYQLMQLSSLTHIHICDFGIEALPHRFSNLTSLESLMLARCQQLQRVDFSDVMPKLRYLEIHNCPLLEALSDGLGNLVSLEELTLRNCEKLEHLPSQDAMRHLTKLQSLKIKGCPKLEESCNNRSGPNSQWSNISHIPKVKVGRSIIQDLPQTPSKFKEFMIFRCSCTFMEGDVDIFVRFYKRHKNYWHNTGPTNISHIPKIEVVGSLIPISKVILEHCCGISSENPWAAITSGELSIRILLPSLHKAG

SEQ ID NO: 118 - protein, 1177 aa, Solanum tuberosum
MEGFLTFAIEETLTRVISIASEGIRLAWGLEGQLQKLKQSVTMIKAVLQDAARRPVTDDSVKLWLENLQDVAYDAEDVLDEFAYEILRKDQKKGKVRDCFSLHNPFAFRLNMGQKVKEINGSLGKILELGSSLGLRNLPEVRRDPRRQTDSILDSSAVVVGREDDVFQVVELLTSTTKSQHVLSVVSIVGMAGLGKTTIAKEVCKVVKDRNLFDVTIWVCVSNHFDEVKILSEMLQKIDKTSGRMDNLDAILENLKKGLEKKTFLLVLDDVWNEFPDKWGGLKEGLLKIKDKNGNAVVVTTRSKEVASMILDTCPGRQHQPQTLLENQCWSIIKQKVNGGGGASMASDLESIGQEIAKKCGGLPLLANVLGGTLSQMETQEWQSIINSKIWESRGGNEALHILRLSFDYLSSPLLKKCFAYCSIFPKDFKIEREELIQLWMAEGFLRPSNGGMEDEGDKCFNDLLANSFFQDVERNECEIVTSCKMHDLVHDLALQVSKSEVLNLEEDSAVDGASHIRHLNLISRGDVEAAFLVGGARKLRTVFSMVDVFNGSWKFKSLRTLKLQRSDVTELPGSICKLRHLRYLDVSCTRIRELPESITKLYHLETLRFTDCMSLQKLPKKMRNLVSLRHLHFDDPKLVPAEVRLLARLQTLPLFVVGPNHMVEELGCLNELRGALKICKLEQVRDREEAEKAKLRQKRMNKLVLEWSDDEGNSGVNNEDVLEGLQPHPNIRSLTIEGYGGEYFPSWMSTLQLNNLTGLRLKDCSKSRQLPTLGCLPRLKILEMSGMPNVKCIGNEFYSSSGSTAVLFPALKELTLSNLDGLEEWMVPGGEGDQVFPFLEVLRIQWCGKLKSIPIYRLSSLVKFVIDGCDELRYLSGEFHGFTSLQILRIWSCPKLPSIPSVEHCTALVELGIYECRELISIPGDFRKLKYSLKRLSVNGCKLGALPSGLQCCASLEVLKIHGWSELIHINDLQELSSLQGLTIAACDKLISIAWHGLRQLPSIVELQITWCRSLSDFQEDDWLGSGLTQLEGLRIGGYSEEMEAFPAGLLNSFQHLNLSGSLKSLAIHGWDKLKSVPHQLQHLTALERLYIKGFSGEGFEEALPDWLANLSSLQSLWIENCKNLKYLPSSTAIQRLSKLKELRIWGGCPHLSENCRKENGSEWPKISHIPKIYIR

SEQ ID NO: 119 - protein, 1313 aa, Solanum tuberosum
MADPVTGATVQVLVDKLLSLTIEEFSSSRDCNKDLEMLTQNVSLIQAFIHDAERRQVEDQSVKVWLNSLERAAENAEYVCDKFRYESLKRQVKIRNNPMRKVSDFFSHTAFKNKMSRKINNINEELRAIYKVAKTLGLQALMVPPRKILPIRETDSIVVASYVVGRDNDVAEIKRKMLNIRDDVVLCTIPIVGMGGLGKTTVAKRIFNDEQIEKHFEKRVWLCLPEMSEIKSFLELILESLTERKLEVQSRDIIVKKLRDELAGGKYLLVLDDLWRVDPTLWDEFVDTLRGINTSRGNFIIVTTRMELVASTVATVLGPHMLEKLSEDHCWSIFKQRAFVDGKIPEEIVSMEKRIVEMCQGLPLAASVLGGLLRSKEKHEWQAILDGNPLVAGENDNGEKSIKKILKLSYDYLPSPYLKKCFAYFAMFPKDFEFEKEQLIQLWMAEGFLHPCQETTVMEDVGHRFFQILLKNSLLQDVELDEHNNITHCKMHDLVHDLAGDILKSKLFDPKGNDGEKPSQVRYFGCESPGDQIDKIYEPERLCTLFWRNNYIWEDMLLSFKLLRVLDLSSSGINELSAKIGNLIYLRYLDLSNTEITALPNSICELYNLQTFRVINCFSLQELPYEMRNMRSLRHIYYTFVDETSGHWGEWCIRNEHFQMPLNMGQLTSLQTLQFFKVGLEKGRQIEELGHLKNLRGELRINGLQLVCDKEEARTAYLQEKPNICKLAYLWSHDESEGCEINDEHVLDGLQPHPNLKTLEVWNYLGTKFPSWFSEELIPNLVKLILSGCKRCKEIPSLGQLKFLRHLELVGFHELECIGPALYGVEISNIGSSSIIQVFPSLKELVLKDMSSLIEWKGAEVGVRMSPGLEKLRITNCPLLKSIPNQFEILRELSIEGVDSEMPLLNLCSNLTSLVFLAVSTVKELTCLPDEMLRSNVSLQRLSVFNCGEFRELPQSLYNLHSLERLVIAGCTNFSSLPVPSGDNNLPSLKLLQLMNCDGLISLPIGMLDQCRSLKVLTVRCCNNLVSFPLHVWEMHSLLHLCISLCPKLISVPKVGLHRLTGLWGLEIGPFSEMVDFDAFQLIFNGIQQLLSLRDLTVYGHGHWDSLPYQLMLWNLEIIGCPKLEESCTNSQRSKISHISYIEVGGMIINDRHICSVVDFHLKSIFTSLSTQGTDWNVVDIGAVGDSGCTKLENSRTISPFIKTSANEGLQQRQLSDLREITIADFGIEALPPRLDNLTSLESLVLSGCKRLQHLNFSDAMPKLRHLWIHDCPLLEALSDGLGNLVSLQELHLQSCEKLENLPSRDAMRRLTK

SEQ ID NO: 120 - protein, 1414 aa, Solanum tuberosum
MNYCLPLSTLQTTTKRRLTLRRLCCIQLRKKTLVQIAEEEEANTTMADPVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVGGFFSHTAFKRKMSQKINNINKELTAINKVAKDLGLQSLMVPSRKILPIRETDSLVVASDIVGRDLDVAEIKEKILKMREEDIVLSTIPIVGMGGLGKTTVAKRIYNDEHMKQIFKKRIWLCLPEMSETKSFLEQILESLIERKIEVERRDIIVKKLQDELGGKKYLLVLDDLWRVDSTSWHEFVDTLRRINTSRGNCILVTTRRKQVASTVATDLHILGKLTEDHCWSIFKQKAFVDGRVPEELASMGNKIVKMCQGLPLAASALGGLLHNKEKHEWQAILDGNLLVTGEDDNGENSIKKILKLSYDYLPSPHLKKCFAYFAMFPKDYMFEKDQLIQLWMAEGFLRPSQEIPVMEDVGHRFFQILLQNSLLQDVVLDEHNNITHCKMHDLVHDLAGDILKSRLFDPKGDNGEKLSQVRYFGCESPTDQIDKIYEPERLCTLFWRSNYTSKDMLLKYKFLRVLDLSSSGIKELSTKIGKLIYLRYLDLSNTEITALPNSICELYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEARTAYLHDKPNICKLAYLWSHDESEGCEINDEHVLDGLQPHPNLKTIAVVDYLGTKFPSWFREESLPNLVKLKLSGSKRCKEIPSLGQLKFLRHLELIGFHELECIGPAFYGVEIRNIGSNSIIQVFPSLKELVLEDMRSLIEWKGDEVGVRMSPGLEKLRITDCPLLKSIPNQFEILRELEIRGVDSEMPLLNLCSNLTSLVNLSVYDMKELTCLPDEILRNNISLQQITIFECGEFRELPQSLYNLHSLYRLDIYNCTNFSSLPVPKGDNYLTSLIFFFLHNCNGLISIPIGMLDQCRSLEYLHVSCCNNLVSFPLHVWEIPSFSVLEITECPKLISVPEVGLHHLTGLLRLGIGPFSEMVDFDAFQLIFNGIQKLLSLRDLEVYGRGHWDSLPYQLMQLSNLRKITIADFGIEALPPRLDNLTSLESLTLERCKRLQHLNFSDAMPKLRHLWISDCPLLEALSDGLGSIVSLEELYLQDCEKLEHLPSRDAMRRLTKLWNMRIKGCPKLEESFTNYSQWSKISHISNIELAIIDVSVVNQAKSYEQQAITGTATVILDEEQSSTVDSLWDTFMSIFGELQSTYETSKTQKRIGCSMRSYTGSILHVFLCPFLVVTCNDPLLHSPRRKRVPKLTFYHFPCFRFMFETPAWTLSKCYLC

SEQ ID NO: 121 - protein, 1188 aa, Solanum chacoense
MADPVIGATVQVLLEKLLSLTTEEFSSSRDCNKDLRMLTQNVSMIQAFIHDAERRQVEDQSMKLWFTRLERAAENAENVFDKFRYESLKRQVKIRNNPMRKVSDFFSHTAFKNKMSRKINNINEELRAINTVAKNLGLQSLMVPPRKILPIQETDSIVVASYVVGRDNDVAEIKEKILTIREDIDLCTIPIVGIGGLGKTTVAKRIFNDEQIEKHFEKRVWLCLPEMSEIKSFLELILESLTKRKVEVQGRDIIAKKLQDELAGRKYLLVLDDLWRVDPTLWDEFVDTLRGINTSRGNFILVTTRMKLVASTVATVLGPHMLEKLSEDHCWSIFKQRAFVDGKIPEEIVSMEKRIVEMCQGLLLAASVLGGLLRSKEKHEWQAILDGNPLVADFEFEKEQLIQLWMAEGFLHPCQEIPAMEDVGHWFFQILLQHSLLQDVELDEQNNITHCKMHDLVHDLAGDILKSKLFDPKGDDGENLSQVRYFGFLPNSICELYNLQTFRVNDCFSLRELPYEMGNMISLRHIYFTSVDKRTLHWGAWCIHYNNFQMPLNMGQLTSLQTLQFFKVGLEKGRQIEELGHLKNLRGELRFKGLQLVCDKEEARTAYLQEKPNICKLAYLWSHDELEGCEINDEHVLDGLQPHPNLKSLAVVGFLGTKFPSWFIEESLPNLVKLKLSGCKKCKEIPSLGQLKFLRHLELVGFHELECIGPALYGVEISNIGSSSIIQVFPSLKELVLEDMHSLIEWKGDEVGVRMSPGLEKLRITDCPLLKSIPNQFEILRELEITGVDSEMPLFNLCSNLTSLVNLSVCNVKKLTCLPDEMLRNNVSLQYLSVTDCEEFRELPQSLYNLHSLKRLRIHSCTNFSSLPVPNGDNYLTSLQLLMLCNCDGLISLPIGMLDQCRSLEILSVSCCDNLVSFPLHVWEMPSLLYLEISRCPKLISVPEVGLHRLTGLWKLEIGPFSEMVDFDAFQLIFNGIQQLLSLRDLEVYGRGHWDSLPYQLMQLSDLIAIKIADFGIEALPPRLDNLTSLERLTLKGCKWLQQLNFSNVMPKLWLLWINDCPLLEALSDGLGNPVSLEELYLQDCEKLEHLPSRDAIRRLTKLWNLGIEGCPKLEENCINSQWSKISHIRNIEVGGRIIKDRHYQSIASMLCFQHSACPLELICCSSNSSSMVTSSKVMLERQCGKSS

SEQ ID NO: 122 - protein, 1360 aa, Solanum chacoense
MADPVIGATVQVLLEKLISLTIEEFSSSRDCNKDLRMLTQNVSMIQAFIHDGERRQVEDQSVKLWFTRLERAAENAENVFDKYRYESLKRQVKIRNNPMRKVSDFFSHTAFKNKMSRKINNINEELRVINKVAKNLSLQSLMVPPRKILPIRETDSIVAASYVVGRDKDVAEIKEKIFTIREDIDLCTIPIVGMGGLGKTTVAKRIFNDEQIEKHFEKRVWLCLPEMSEIKSFLELILESLTERKLEVQSRDIIVKKLRDELAGKKYLIVLDDLWSVDPTLWDEFVDTLRGINTSRGNFILVTTRMELVASTVAAVPGPHKLEKLAEDHCWSIFKQRAFVDGKIPEEIVRMEKRIVEMCQGLPLAASVLGGLLLRKEKHEWQAILDGNPLVAGENDNGVKSIKKILKLSYDYLPSPQLKKCFAYFALFPKDFEFEKEQLIQLWMAEGFLHPCQEIPVMEDVGHRFFQILLQNSLLQDVELDEHNNITHCKMHDLVHDLAGEILKCKLFDPKGDDGEKLSQVRYFGCESPMDQIGKIYAPERLCTLFWRDNYIWEDMLLSFKFLRVLDLSSSGINEVSAKIGKLIYLRYLDLSNTNITALPNSICELYSLQTFRVINCFSLKELPYEMGNMISLRHIYYSSINKRNRHWGGWCIRNEHFQMPLNMGQLTCLQTLQFFKVGLEKGHQIEELGHLKNLKGKLRINGLQFVCDKEEARTAYLQEKPNICELVYLWSHVESEGCEINDEHVLDGLQPHPNLKTLAVGNYLGTKFPSWFSEESLPNLVKLKLIGCKRCKEIPSLGQLKFLRHLELVGFHELECIGPALYGVEISNIGSNSIVQVFPSLKELVLEDMRSLIEWKGDEVGVRMSPGLEKLRITDCPLLKSIPNQFEILRDLEIRGVDSEMPLLNLCSNLTSLVSLDVCNVKELTFLPDEMLRNNVSLQHLSVFHCGEFRELPQSLYNLHSLKILVIHNCTSFSSLPVPKGDNYLTSLQLFQLYNCDGLISLPIGMLDQCRSLDFFSVRCCNNFVSFPLHVWEMPSLSYFDISQCPKLISVPEVGLHRLTGLWYLGIGPFSEMVDFDAFQLIFNGIQQLLSLRDLAVYGRGHWDSLPYQIMQLSDLREITIADFGIEALPPRLVNLTSLESLTLVRCKRLQHLNFSDAMPKLRLLWIGDCPLLEALSDGIGNLVSLEELYLQDCEKLEHLPSRDAMRRLTKLWNLEIKGCPKLEESCTNSQWSKISHIPNIEVGGRIIKDRLLMSDPPLSQTVRNKKNLSICHIYSGAKMKIMGQIATFCFSGDCGCTKLESSRYMFEPPSMLLVLDVFECHDWQGKSHVAEIGVEILFTCMTKICTNIVHFSSKHFEL

SEQ ID NO: 123 - protein, 1507 aa, Solanum chacoense
MADPVIGATVQVLLEKLLSLTIEEFNSSRDCNKDLGMLTQNVSMIQAFIHDAERRQVEDQAVKLWLNRLERAAENAENVFDKFRYESLKRQVKIRNNPMRKVSDFFSHTAFKNKMSRKVNNINEELRGINMLAKDLGLQSFMVPPRKILPIRETDSIVVASYIVGREKDVAEIKEKILTIREDIDLCTIPIVGMGGLGKTTVAKRIFNDEQIEKHFEKRVWLCQPEMSETKSFLELILESLTERKVEVLSRDIIVKKLRDELAGRKYLLVLDDLWGVDSTLWDEFVDTLRGINTSRGNFILVTTRMELVASTVAAVLGPHKLEKLSEDHCWSIFKQRAFVDGKIPEEIVSMEKRIVEMCQGLPLAASVLGGLLRSKGKHEWQAILDGNPLVAGENDNGEKSIKKILKLSYDYLPSPQLKKCFAYFAMFPKDFEFEKEQLIQLWMAEGFLHPCQETTVMEGIGHRFFQILLQNSLLQDVELDEHNNITHCKMHDLVHDLAGDILKSKLFDPKGNDGEKLSQVRYFGCESPMDQIDKIYEPERLCTLFWRNNYIWEDMLLSFKFLRVLDLSSSGIKELSAKIGMLIYLRYLDLSNTKITALPNSICKLYNLQTFRVINCHSLKELPYEMGNMISLRHIYYTSVDKGNQHWGGWCILNEHFQMPLNMGQLTSLQTLQFFKVGLEKGRQIEELGHLKNLRGELRINGLQLVCDKEEARTTYLQEKPNICKLAYLWSHDDSEGREINDEPVLDGLQPHPNLKTLSVVNYLGTKFPSWFSEVSLPNLVKLKLSGSKRCKEIPSLGQLKFLRHLELIGFHELECIGPALYGVEVSNIGSNSIIQVFPSLKELVLEDMRSLIEWKGDEVGVRMSAGLEKLRITDCPLLKSIPNQFEILRDLEITGVDSEMPLLNLCSNLTSLVYLEVCKVKELTCLPDEMLRNNVSLQQILIFGCGKFRELPQSLYNLHSLRILEIICCTNFSSLPVPCGDNYLTSLQIFQLTDCDGLISLPIGMLDQCRSLELLNVICCDNLVSLPLHVWEMPSLSRLNISQCPKLISVPEVGLHRFAGLQTLKIGPFSEMVDFDAFQLIFNGIQQLLSLCDLAVYGRGHWDSLPYQIMQLSDLREITIADFGIEALPPRLDNLTSLERLSLAGCKWLQHLNFSDAMPKLRLLWISDCPLLEALSDGLGNLVSLQELYLQNCEKLEHLPSRDAMRRLTKLWNLRIIEGCPKLEESCTNSQWSKISHIPNIEVGGRIIKDRRTTTVHSLWDTFMGIWVLNNLFGELKSTYETSKTQKCIGCSMRSYTGLSSVFAWPCLSFYSPLLMSDPLLSQPLVSMDAVGRMLWYKGNSLGQIATFCFSGDCGCTKLESLSMGLVEMQLSDLREIEIADFGIEAFPPRLDNLISLERLTLVRCKRLQHLNFSDAMPKLQDLWINDCPLLEALLDGLRNLVSLQELHLRNYEKLEHLPSRDAMRRLTKLWKLDIIGCPKLQESCTNSQWSKISHIPRIEVVLNE

SEQ ID NO: 124 - protein, 1823 aa, Solanum chacoense
MADPVIGATVQVLLDKLLSLTIEEFSSSRDCNKDLEMLTQNVSLIQAFIHDAERRQVEDKAVKLWLNRLDRAAENAEYVFDKFRYESLKRQVKIRNNPMRKVSDFFSHTAFKNKMSRKINNINEELRAINKVAKTLGLQALMVPPQKILPIRETDSIVVASYVVGRDNDVAEIKRKMLNIRDDVVLCTIPIVGMGGLGKTTVAKIIFNDEQIEKHFEKRVWLCLPEMSEIKSFLELILESLTERKLEVQSRDIIVKKLRDELAGRKYLLVLDDLWHVDPTLWDEFVETLRGINTSRGNIILVTTRMELVASTVAAVLGPHMLEKLAKDHCWSIFKQRAFVDGKIPEEIVRMEKRIVEMCQGLPLAASVLGGLLRSKEKHEWQAILDGNPLVAGENDNGEKSIKKILKLSYDYLPSPQLKKCFAYFAMFPKDFEFEKEQLIQLWMAEGFLHPCQETTVMEDVGHRFFQILLKNSLLQDVELDEHDNITHCKMHDLVHDLAGDILKSKLFDPKGNDGEKLSQVRYFGCESPGDQIDKIYEPKRLCTLFWRNNYISEDMLLSFKLLRVLDLSSSGINELSTKIGNLIYLRYLDLSNTEITALPSSICELYNLQTFRVINCFSLQELPYEMRNMISLRHIYYTFVDETSGHWGEWCIRNEHFQMPLNMGQLTSLQTLQFFKVGLQKGRQIEELGHLKNLRGELRINGLQLVCDKEEARTAYLQEKPNICKLAYLWSHDESEGCEINDEHVLDGLQPHPNLKTLEVWNYLGTKFPSWFSEELIPNLVKLILSGCKRCKEIPSLGQLKFLRHLELVGFHELECIGPALYGVEISNIGSSSIIQVFPSLKELVLEDMSSLIEWKGAEVGVRMSPGLEKLRITDCPLLKSIPNQFEILRELRIEGVDSEMPLLNLCSNLTSLVHLSVSNVKELTCLPDEMLRSNVSLQHLSVFECGEFRELPQSLYNLHSLKRLVIACCTNFSSLPVPSGDNNLTSLQLLQLMNCDGLISLPIGMLDQCRSLKFLSVRGCNNLVSFPLHVWEMHSLLHLCISLCPKLISVPEVGLHRLTGLWGLEIGPFSEMVDFDAFQLIFNGIQQLLSLRALTVYGHGHWDSLPYQLMQLSDLREIVIGDFGIEALPPSLDNLTSLESLMLSGCKRLQHLNFSDAMPKLRHLWIHGCPLLEALSDGLGNLVSLQELHLQNCEKLENLPSRDAMRRLTKLWNLQIRGCPKLGESCTNSQRSKISHISNIEVGGRIIDDRRTMVKGTDWNVVDIGAVGDSGCTKLENSSNLTSLVHLAVSNVKELTCLPDEMLRNNVSLQHIMIFHCGEFRELPQSLYNLHSLKRLEISSCINFSSFPVPRGDNYLTSLQLFHLCVPEVGIHRLTGLRGLEIGPFSEMVDFDAFQLIFNGIQQLLSLCDLAVYGRGHWDSLPYQIMQLSDLREITIADFGIEALPPRLDNLTSLERLSLAGCKRLQHLNFSDAMPKLWLLWISDCPLLEALSDGLGNLVSLEDLYIGNCKKLEHLPSRDAMQHLTKLRNLRIEGCPKLEENCTNSQWSKISHIPRINVDGRIIKDRRTTSVILYEEQHSTVDSLWDTLMSIWVLNNLFGELKSTYETSKTQMRSYMCIDEDIGSNGWSLGGCCGTKAIHCMCTSRIEKHSIGITSTSYWCNTRGDRLEHFASVVTVVARSLKVQVSSLAREIAICKLICIWQNVNWRSRKGSKEQLLPVTLLDFSTMYMYVCIWDTKIHERVASEMRERGHIGTFCISGAFGDLGYIIKWAGSAKMVTEQLQQEVTIFGGIKVDLILDIYASNTFHPYCLKKIISKNGGSY

SEQ ID NO: 125 - DNA, 7907 bp, Solanum chacoense
  CDS (3358)..(7266)
acgcatcaggaagagaggagatttgtccctttcattccctcttcttcatcatcttttgtgagtagatgttcttttgctgggttttgtctctacgttgaaagaaatccactaatgttacaacaagtggaagagaatacatgattgtactggacttttttttccatatataaattaaaaaaatgactcaaacaaataaaataaaattacttgtacaaatcatatatatatatatctatatatataataagccacaatgcaaatatatataaagtatttagttacattgtaactatcttgttagctttcaaccaaaagctaacaagatttttagttacatatttattatttagttaaataataaatatgtcattgtatgagctatttattactcattccttttgaatttgttaatatgattttgatatgacacatagtttacgaaagtaaattagatttttagaaaaaacattatttacgaaagtaaattagattttgagaaaaaacattaagtcatacttgaagttgtcccagattttcaaaaagacaccttaactttgcgtgcgtcctattaccccacaaaacattcaaaatcacaataaatacacattttttacacaatattttcattttggacaaaaatatccttcgaatgtgcaatttcttaaaaacaaaaagtcggacccattattgatgtattgaaggatgctttggtcatttcctatgatgaattagttttgtttgtttcttttaaatttattttactatactaaataattgtataaaatattctgaatcacgataattaattacttaaatatttaaaagatataaaaatatataaaagatcttattgactcttcaaattttaccagtgacacataaattgggacaaatgaaataatatatattatttgaaaatttcttagaaagtactataaattacagtaattaacagctagaaatatttcaaagacaaaaaaatttgattgaatctcaaaatatcttttagtactacataaattgagaaagaagaaataacctctattattttaaaatgacgtaaaaatattacaaatcatacaataagaattaacaatttaaaactttaaaagactttaatgctttatacttattctattttcactttggacaaaaatatcctcccaatatgcatattttttaaacaaaaagtgggacctattattgatgtattcaaggatgctttggtaattttcctatgatgaattcgttttgtttgttgtttaattttttttaaaataattgtataaaatattataaatcacaataattatttacttaaatattcaaaagatataaaaatatgtaaaagatcttattaactcttcaaattttatcggtgacacataaattggacaaatgaaataatatatattatttgaaaattacttagaaagtacaataatttacagtaattaacaatagaatattttaagacaaaaaaattgattgaatctcgaaattttattagtaccacataaattgagaaagaagaaataacctttattatttcaaaattgcgtaaaagatattacaaatcatacaacaataattagcaatttagaatgttaaaagacataaaaatcttttttaccatagctaacaataattaaaaatttaaactattttaaattaatattaaagtttgattaacactttaattttgtctttgccacataaattgaaacaaaaaatgatatatattgggcccgtgctagcacgggctccgatgtctagtatatatatatatatatatatataggagaaacatagagaaggtgatgtgacacctctctatggcctccattcatatatttttttttcctttttttcttatttaaatcaattattttattgtaaaagtaaattgattaattttttgtaaataaatattttattaatagaggaacaattacaacaaaaactcttcatatgccaattaacaaagagtaactatctataactcacacctctctaattttcaattttaataaatttatttttatttgtatctctttttttaccttcttctaatcgtaaaatgacaacatttttttaaatatcttctctctttattatttaatttctttacaatctatctatatcgatgtattttaagtattaacgttttcaatgcttattatgtttgatgctttggattgacttgaaagaagatgaaggctattgaatgatggctatggcttgtgaaaatggatgtcaataaaagctcaaaaaattgtatattaatttcatttttaaaaatattttaataattaagaacataaaaataatacaattatttattattttaattctttcatgatttctctttatcaaacatcaaaagttcattttataaatggattgcacctagagttgcatttccccatcataaatatgattatttttaatcatttatatgtgtaagagccgtttttaaaattctgtattgcgattctaatattaaaaaaaaaaaatttataatgttttactgatttttatagtaacactgtactaatgatttgtttttcctattcctgactatattaattactttcatattctcaaattaaatgggataattaatgggtaataatgtttatacttcttcatattttataacatgtttttatgcgtgatttctgtaatagcttttcttatattttatgttgagactttgaaaatatattttggttatttatctttattattgtgaagttagaagatgaaaagggaatatgattggacaattttcaaaagataatgagtaattatgtcggaaagtatttgaggagattaagttaaaagattaaaaataaatattcatgttttaaaatttagtaatacatatacttgaagaaagaatttgatttttcttgaacttctatcctttctttacattcttttaacaaatataaaaatatcatttcacttatatagattatacattatacaagttttatagagaggctctgaattttcaagtgctgaaaaatcatagaaaatgtactaataatataattgattagaatattatacaagttttatggaaaggctctgaatttttaagtgctaaaaaatcatagagactttactaataatataattgattaaatttaaaatatttaagaaaaaatctaatatcaaaaattcatacgcgcgaagcgcgaataagttctcttgtaaaaatgtaaatagaactgcttgtacaaataaaacaaaaagctacttaaataaattaatataaagggaaaaagagactcaaacttggtttcatccacatgtattttttttttattactgtttgaatgattgtatatgaattattgtcttccttcgagtactctacaaacaactaccaaacgaagacttactttgagaagactttgttgcaaacagctcaggaagaagactttggtgcagactgcagaggaagaggaagcaaacacaacaatggccgatcctgtaattggtgctactgttcaagttttgcttgaaaagttgatttctctcactatcgaggaagtcaacagctcaagggatttcaacaaagatctcgaaatgttgacacaaaatgtatctttaatccaagctttcattcatgatgttgaaacaccacaagagaaacaacagtctgtggaacaatggctcaacaggcttgagagagttgctgaagatgctcaaaatgtgtttgatcgattcatatatgaatctctcaaaacaaaagtggtgaggagcccattgaaaaaggtcagtggtttcttttctcatactgcttttaagagaaaaatgtctcaaaaaatcaacaacatcaataaagagttgacggctatcaataaggtagccaaagacctcggtctacaatcactcatggttccttctcggaaaatactaccaattcgagaaacagattcctttgtagttgcttctgatattgtcggtagagatttggatattgctgagataaaggagaagattttgaacatgagagaggaggatattgttctgtccaccattcccatagtaggtatgggaggtttagggaaaacaactgtggctaagaggatttacaatgatgaacacatgaagcaaatctttgaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggtgtgttgactctacatcgtggcatgagttcattgacaccttgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttctgttagatgaacacaacaatataacacactgcaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggtcaagttgaaattaagtggtagcaaaaggtgcaaagaaattccatcccttggccaactgaaattccttcggcatcttgagctgataggattccatgagttggaatgcattggacctgctttttatggtgttgagatgagaaatattggatcaaacagcattatccaagtgttcccgtcattgaaaaaactagtattgaaggatatgcgtagccttattgagtggaagggagatgaagttggagtaagaatgtctcccggtcttgagaagttgcggattacagactgtccattgttaaaaagtattccgaatcaatttgaaatcctccgtcaattaaaaattacaggagttgacagtgaaatgccattgttgaacttgtgcagcaacttgacatctctcgtaaagcttagagtctatgatatgaaagagctcacttgtcttccagatgagatgctacgtaacaacgtttctcttcaacagataataattttcaactgcggagagtttcgtgaattgccacaaagcttgtacaatctccattctcttaggagattagacatttacaactgcaccaatttcagttctcttcctgttcccaatggagacaactatttgacttccctcgaattcttttgcttacataattgtaatggattgatcagtataccaattggaatgctagatcaatgccggctagtgtttttgaatgtcagctgctgtaacaacttggtttcattccctgtacatgtgtgggaaatgccttcactttcatatttgcttatatcagaatgtcccaaattgattagtgtacccaaagtgggccttcaccatctcaccgggttagtgagattgggaattggtcctttctcagagatggtggattttgatgcattccaattgatttttaatggcattcagcagttgttgtcccttcgtgatctggaggtgtacggacgtgggcactgggattctctgccctatcagcttatgcaactctctgacctaagagagatcacaatagctgatttcggaattgaggctcttcctcctactcttgacaaccttacttctcttgaaagtttgacgctagtgaggtgcaaacagctacaacatctgaacttctcagatgccatgcccaaattacggctcctgtggatacgtgattgtccattgttagaagctctgtcggatgggctcggcaaccttgtttctttggaagaattatatttacatgactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacagccataagtctcggtttctctttcactttctgagtcgcttgcatttttaattagaatattattttccacgagttccaaaaaagaagttttgtaagtaatgtaataatttttcttgaaattattttgacataaaaaaaaaagctagattatcaatcaattgcatctgttgctatgctttcaggattctgcttgtccacttgaactgaattgctgttattctaaaaattatgtttcttttccttatagatagccattatagacgtctctgtggtaaatcaagccaaatcatatgagcagcaggcaattacgtaaggtaaattttcatttataatttataggcactttgtaatctacttgtttctatctttctttttgttggaaaccaatttttggaggtctatgctgatgaatacaacattaccttccttaaaaaaaagtttaatcatgaaaatttatgatttctgctcataggttactaggtacaaggacatggtagaacatcgttgtggtatatctagtcaaaatccatgggcagaatcatgttaggcatttttatttagttgttagaggaatgctataacaagtttgtaaagtttctctttttttactttccttttctctcatgaaataattttaatgtttaacgggacttgtcgtgtttcacagaggaaccg

SEQ ID NO: 126 - protein, 1302 aa, Solanum chacoense; identical to SEQ ID NO: 110

SEQ ID NO: 127 - protein, 113 aa, Phytophthora infestans
MATATVLVQSPASGLTTTVADTAQTATSILTPVLAGEPNKHVTTRSLRTHPIADSDDGEERLLNGMTDFVKYHAGKMNPEQLYKYLKLQGRGQEAYKHKNYASYIKKSKKWWK

SEQ ID NO: 128 - protein, 115 aa, Phytophthora infestans
MATATVLVQSPASGLTTTVADTAQTATSILTPVLAGEPNKHVTTRSLRTHPIADSDDGEERLLNGMTDFVKYHAGKMNPEQLYKYLKLQGRGQEAYKHKNYASYIKKSKKWWKNQ

SEQ ID NO: 129 - protein, 123 aa, Phytophthora infestans
MRVLCLALMATATVLVPSPASGLTTTVADTAQTATSILTPVLAGEPNKHVTTRSLRTHPIADSDDGEERLLNGMTDFVKYHAGKMNPEQLYKYLKLQGRGQEAYKHKNYASYIKKSKKWWKNQ

SEQ ID NO: 130 - protein, 123 aa, Phytophthora infestans
MRVLCLALMATATVLVQSPASGLTTTVADTAQTATSILTPVLAGEPNKHVATRSLRTHPIDDSDDGEERLLNGMTDFFKYHAGKMSPEQLYKYLNLKGLGQEAYKHKNYASYIKKSKKWWKNQ

SEQ ID NO: 131 - protein, 123 aa, Phytophthora infestans; identical to SEQ ID NO: 130

SEQ ID NO: 132 - protein, 123 aa, Phytophthora infestans
MRVLCLALMATATVLVPSPASGLTTTVADTAQTATSILTPVLAGEPNKHVATRSLRTHPIDDSDDGEERLLNGMTDFFKYHAGKMSPEQLYKYLNLKGLGQEAYKHKNYASYIKKSKKWWKNQ

SEQ ID NO: 133 - protein, 123 aa, Phytophthora infestans; identical to SEQ ID NO: 132

SEQ ID NO: 134 - protein, 84 aa, Phytophthora infestans
MRVLCLALMATATVLVPSPASGLTTTVADTAQTATSILTPVLAGEPNKHVATRSLRTHPIDDSDDGEERLLNGMTDFFKYHAGK

SEQ ID NO: 135 - protein, 70 aa, Phytophthora infestans
MRVLCLALMATATVLVPSPASGLTTTVADTAQTATSILTPVLAGEPNKHVATRSLRTHPIDDSDDGEERL

SEQ ID NO: 136 - DNA, 20 bp, Artificial
  primer
gcggagagtttcgtgaattg

SEQ ID NO: 137 - DNA, 21 bp, Artificial
  primer
cccacacatgtacagggaatg

SEQ ID NO: 138 - DNA, 22 bp, Artificial
  primer
acatctctcgtaaagcttagag

SEQ ID NO: 139 - DNA, 22 bp, Artificial
  primer
acagataataattttcaactgc

SEQ ID NO: 140 - DNA, 22 bp, Artificial
  primer
atttgggacattctgatataag

SEQ ID NO: 141 - DNA, 22 bp, Artificial
  primer
cactttcatatttgcttatatc

SEQ ID NO: 142 - DNA, 22 bp, Artificial
  primer
gacaatcacgtatccacaggag

SEQ ID NO: 143 - DNA, 55 bp, Artificial
  primer
ggggacaagtttgtacaaaaaagcaggctatgaattattgtcttccttcgagtac

SEQ ID NO: 144 - DNA, 53 bp, Artificial
  primer
ggggaccactttgtacaagaaagctgggttcagaaagtgaaagagaaaccgag

SEQ ID NO: 145 - DNA, 46 bp, Artificial
  primer
ggggacaactttgtatagaaaagttgacgcatcaggaagagaggag

SEQ ID NO: 146 - DNA, 48 bp, Artificial
  primer
ggggactgcttttttgtacaaacttgatacaatcattcaaacagtaat

SEQ ID NO: 147 - DNA, 47 bp, Artificial
  primer
ggggacagctttcttgtacaaagtgggtcgcttgcatttttaattag

SEQ ID NO: 148 - DNA, 46 bp, Artificial
  primer
ggggacaactttgtataataaagttggcggttcctctgtgaaacac

SEQ ID NO: 149 - DNA, 50 bp, Artificial
  primer
ggggacaactttgtatagaaaagttgtgatttgtttttcctattcctgac

SEQ ID NO: 150 - DNA, 20 bp, Artificial
  primer
atgaattattgtcttccttc

SEQ ID NO: 151 - DNA, 22 bp, Artificial
  primer
acacaaaatgtatctttaatcc

SEQ ID NO: 152 - DNA, 22 bp, Artificial
  primer
agagttgacggctatcaataag

SEQ ID NO: 153 - DNA, 22 bp, Artificial
  primer
ttacaatgatgaacacatgaag

SEQ ID NO: 154 - DNA, 22 bp, Artificial
  primer
gaggaataaatacatccagagg

SEQ ID NO: 155 - DNA, 21 bp, Artificial
  primer
acaaagaaaaacatgaatggc

SEQ ID NO: 156 - DNA, 19 bp, Artificial
  primer
gaagacgttgggcacaggt

SEQ ID NO: 157 - DNA, 20 bp, Artificial
  primer
ttgtgcacactgttttggag

SEQ ID NO: 158 - DNA, 21 bp, Artificial
  primer
tgagatgagaaatatgataag

SEQ ID NO: 159 - DNA, 21 bp, Artificial
  primer
tgataaagaagaggctcaaac

SEQ ID NO: 160 - DNA, 21 bp, Artificial
  primer
gcaaagaaattccatcccttg

SEQ ID NO: 161 - DNA, 22 bp, Artificial
  primer
cagactgtccattgttaaaaag

SEQ ID NO: 162 - DNA, 20 bp, Artificial
  primer
aatctccattctcttaggag

SEQ ID NO: 163 - DNA, 21 bp, Artificial
  primer
atatcagaatgtcccaaattg

SEQ ID NO: 164 - DNA, 21 bp, Artificial
  primer
aattgaggctcttcctcctac

SEQ ID NO: 165 - DNA, 22 bp, Artificial
  primer
cctcactaaattatggaacatg

SEQ ID NO: 166 - DNA, 21 bp, Artificial
  primer
tgcaggacgcatcaggaagag

SEQ ID NO: 167 - DNA, 22 bp, Artificial
  primer
ataagccacaatgcaaatatat

SEQ ID NO: 168 - DNA, 22 bp, Artificial
  primer
atttagttacattgtaactatc

SEQ ID NO: 169 - DNA, 22 bp, Artificial
  primer
gagaaaaaacattaagtcatac

SEQ ID NO: 170 - DNA, 24 bp, Artificial
  primer
tcttttaaatttattttactatac

SEQ ID NO: 171 - DNA, 21 bp, Artificial
  primer
caaaatatcttttagtactac

SEQ ID NO: 172 - DNA, 22 bp, Artificial
  primer
tatgatgaattcgttttgtttg

SEQ ID NO: 173 - DNA, 20 bp, Artificial
  primer
ctcgaaattttattagtacc

SEQ ID NO: 174 - DNA, 20 bp, Artificial
  primer
tgatatatattgggcccgtg

SEQ ID NO: 175 - DNA, 20 bp, Artificial
  [primer
atctataactcacacctctc

SEQ ID NO: 176 - DNA, 21 bp, Artificial
  primer
ttgaatgatggctatggcttg

SEQ ID NO: 177 - DNA, 22 bp, Artificial
  primer
gtttttaaaattctgtattgcg

SEQ ID NO: 178 - DNA, 21 bp, Artificial
  primer
ttattattgtgaagttagaag

SEQ ID NO: 179 - DNA, 20 bp, Artificial
  primer
agttttatagagaggctctg

SEQ ID NO: 180 - DNA, 21 bp, Artificial
  primer
aagcgcgaataagttctcttg

SEQ ID NO: 181 - DNA, 3912 bp, Solanum berthaultii
  CDS (1)..(3912)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacactggctcaacaggcttgagagagttgctgaagatgctgaaaatgtgtttgatcgattcagatatgaatctctcaaaacaaaagtggtgaggagcccattgaaaaaggtcagtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttcgtaggtgcttctgatgttgttggtagagatttagatgttgctgagataaaggagaagattttgaagatgagagaggaggatgttgttctgtccaccattcccatagtaggtatgggaggtttagggaaaacaactgtggctaagaggatttacaatgatgaacacatcaagcaaatctttaaagagagaatttggttgtgtatacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtatgaagcgggtggcatccacagtagcaacagatcttcatatcttggggaagttaacagaagatcattgttggtctattttcaaacaaaaagcatttgttgatggcagggttccagaggaattagcgagcatgggcaacaatattgttaaaatgtgccaaggtctaccgttggctgcaagtgcattgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaacaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttgtgttagatgaacacaacaatataacacactgtaagatgcacgatcttgtgcatgatttggctggagatatcttaaaatctagactatttgatccgaagggcgacaatggagaaaaactttctcaagttcgatactttggatgtgagtcaccaaaggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcgagctctataatttgcaaacatttagagtcatcaactgcttttcactccagggacttccatatgagatgagaaatatgataagtttgagacacatatattacacttctattgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaggaggtgaattgacaatcaatggtctccaattggtctgtgataaagaagaggctcgaacagcatatttacacgataaaccaaacatctgcaagctggcatatttatggtcccatgatgaatcagaaggctgtgtgatcaatgatgagcatgtgttggatggtcttcaaccgcatcctaacttgaaaaccttagcagtagtggactatttagggactaaatttccttcatggttcagtgaagagtcgctaccaaatttggttaagttgaaattaagtggtagcaaaaggtgcaaagaaattccatcccttggccaactgaaattccttcggcatcttgagctgataggattccatgagttggaatgcattggacctgctttatatggtgttgagattagaaataccggatcaaacagcaatatccaagtgttcccgtcattgaaagaactagtattggaggatatgcgtagccttattgagtggaagggagatgaagtcggagtaagaatgtctcccgggcttgagaagttgcggattacagactgtccattgttaaaaagtattccaaatcaatttgaaatcctctgtgaattagaaattagaggagttgacagtgaaatgccattgttgaacttgtgcagcaacttgacatctctcgtaaagcttagtgtctatgatatgaatgagctcacttgtcttccagatgagatactacgtaacaacgtttctcttcaacagataacgattttcaactgtggagagtttcgtgaattgccacaaagcttgtacaatctccattctcttaagagattagacatttacaactgcaccaacttcagttctcttcctgttcccaatggagacaactatttgacttccctcgaattctttttcttatataattgtaatggattgatcagtataccaattggaatgctagatcaatgccggtctctagagtttttgcatgtcagctgctgtaacaacttggtttcattccctttacatgtgtgggaaatgccttcattttcatttttggatataagagaatgtcccaaattgattagtgtacccaaagtgggccttcaccatctcaccgggttattgagtttgggaattggtcctttctcagagatggtggattttgatgcattccaattgatttttaatggcattcagcagttgttgtcccttcgtgatctggaggtgtacggacgtgggcactgggattctctgccctatcagcttatgcaactctctaacctaagagagatcacaatagctgatttcggaattgaggctcttcctcctagacttgacaaccttacttctcttgaaagtttgacgctagacaggtgcaaacggctacaacatctgaacttctcagatgccatgcccaaattacggcttctgtggataagtgattgtccattggtagaagctctgtcggatgggctcggcaaccttgtttctttggaagaattatatttacaggactgcgaaaaactagagcttctaccgtcccgagatgccatgcgacgcctcactaaattatggaacatgggaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 182 - protein, 1303 aa, Solanum berthaultii
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEHWLNRLERVAEDAENVFDRFRYESLKTKVVRSPLKKVSGFFSHTAFKRKMSQKINNINKELTAINKVAKDLGLQSLMVPSRKILPIRETDSFVGASDVVGRDLDVAEIKEKILKMREEDVVLSTIPIVGMGGLGKTTVAKRIYNDEHIKQIFKERIWLCIPEMSETKSFLEQILESLIERKIEVERRDIIVKKLQDELGGKKYLLVLDDLWRVDSTSWHEFVDTLRGINTSRGNCILVTTRMKRVASTVATDLHILGKLTEDHCWSIFKQKAFVDGRVPEELASMGNNIVKMCQGLPLAASALGGLLHNKEKHEWQAILDGNLLVAGEDDNGENSIKKILKLSYDYLPSPHLKQCFAYFAMFPKDYMFEKDQLIQLWMAEGFLRPSQEIPVMEDVGHRFFQILLQNSLLQDVVLDEHNNITHCKMHDLVHDLAGDILKSRLFDPKGDNGEKLSQVRYFGCESPKDQIDKIYEPERLCTLFWRSNYTSKDMLLNFKFLRVLDLSSSGIKELSAKIGKLIYLRYLDLSNTEITALPNSICELYNLQTFRVINCFSLQGLPYEMRNMISLRHIYYTSIDETSGHWGGWCLHNEHFQIPLNMGQLTSLQTLKFFKVGLEKGRQIEELGHLKNLGGELTINGLQLVCDKEEARTAYLHDKPNICKLAYLWSHDESEGCVINDEHVLDGLQPHPNLKTLAVVDYLGTKFPSWFSEESLPNLVKLKLSGSKRCKEIPSLGQLKFLRHLELIGFHELECIGPALYGVEIRNTGSNSNIQVFPSLKELVLEDMRSLIEWKGDEVGVRMSPGLEKLRITDCPLLKSIPNQFEILCELEIRGVDSEMPLLNLCSNLTSLVKLSVYDMNELTCLPDEILRNNVSLQQITIFNCGEFRELPQSLYNLHSLKRLDIYNCTNFSSLPVPNGDNYLTSLEFFFLYNCNGLISIPIGMLDQCRSLEFLHVSCCNNLVSFPLHVWEMPSFSFLDIRECPKLISVPKVGLHHLTGLLSLGIGPFSEMVDFDAFQLIFNGIQQLLSLRDLEVYGRGHWDSLPYQLMQLSNLREITIADFGIEALPPRLDNLTSLESLTLDRCKRLQHLNFSDAMPKLRLLWISDCPLVEALSDGLGNLVSLEELYLQDCEKLELLPSRDAMRRLTKLWNMGIKGCPKLEESFTNYSQWSKISHISNIELGGWRRTAISLGFSFTF

SEQ ID NO: 183 - DNA, 3912 bp, Solanum berthaultii
  CDS (1)..(3912)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacactggctcaacaggcttgagagagttgctgaagatgctgaaaatgtgtttgatcgattcagatatgaatctctcaaaacaaaagtggtgaggagcccattgaaaaaggtcagtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttcgtaggtgcttctgatgttgttggtagagatttagatgttgctgagataaaggagaagattttgaagatgagagaggaggatgttgttctgtccaccattcccatagtaggtatgggaggtttagggaaaacaactgtggctaagaggatttacaatgatgaacacatcaagcaaatctttaaagagagaatttggttgtgtatacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtatgaagcgggtggcatccacagtagcaacagatcttcatatcttggggaagttaacagaagatcattgttggtctattttcaaacaaaaagcatttgttgatggcagggttccagaggaattagcgagcatgggcaacaatattgttaaaatgtgccaaggtctaccgttggctgcaagtgcattgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaacaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttgtgttagatgaacacaacaatataacacactgtaagatgcacgatcttgtgcatgatttggctggagatatcttaaaatctagactatttgatccgaagggcgacaatggagaaaaactttctcaagttcgatactttggatgtgagtcaccaaaggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcgagctctataatttgcaaacatttagagtcatcaactgcttttcactccagggacttccatatgagatgagaaatatgataagtttgagacacatatattacacttctattgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaggaggtgaattgacaatcaatggtctccaattggtctgtgataaagaagaggctcgaacagcatatttacacgataaaccaaacatctgcaagctggcatatttatggtcccatgatgaatcagaaggctgtgtgatcaatgatgagcatgtgttggatggtcttcaaccgcatcctaacttgaaaaccttagcagtagtggactatttacggactaaatttccttcatggttcagtgaagagtcgctaccaaatttggttaagttgaaattaagtggtagcaaaaggtgcaaagaaattccatcccttggccaactgaaattccttcggcatcttgagctgataggattccatgagttggaatgcattggacctgctttatatggtgttgagattagaaataccggatcaaacagcaatatccaagtgttcccgtcattgaaagaactagtattggaggatatgcgtagccttattgagtggaagggagatgaagtcggagtaagaatgtctcccgggcttgagaagttgcggattacagactgtccattgttaaaaagtattccaaatcaatttgaaatcctctgtgaattagaaattagaggagttgacagtgaaatgccattgttgaacttgtgcagcaacttgacatctctcgtaaagcttagtgtctatgatatgaatgagctcacttgtcttccagatgagatactacgtaacaacgtttctcttcaacagataacgattttcaactgtggagagtttcgtgaattgccacaaagcttgtacaatctccattctcttaagagattagacatttacaactgcaccaacttcagttctcttcctgttcccaatggagacaactatttgacttccctcgaattctttttcttatataattgtaatggattgatcagtataccaattggaatgctagatcaatgccggtctctagagtttttgcatgtcagctgctgtaacaacttggtttcattccctttacatgtgtgggaaatgccttcattttcatttttggatataagagaatgtcccaaattgattagtgtacccaaagtgggccttcaccatctcaccgggttattgagtttgggaattggtcctttctcagagatggtggattttgatgcattccaattgatttttaatggcattcagcagttgttgtcccttcgtgatctggaggtgtacggacgtgggcactgggattctctgccctatcagcttatgcaactctctaacctaagagagatcacaatagctgatttcggaattgaggctcttcctcctagacttgacaaccttacttctcttgaaagtttgacgctagacaggtgcaaacggctacaacatctgaacttctcagatgccatgcccaaattacggcttctgtggataagtgattgtccattggtagaagctctgtcggatgggctcggcaaccttgtttctttggaagaattatatttacaggactgcgaaaaactagagcttctaccgtcccgagatgccatgcgacgcctcactaaattatggaacatgggaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 184 - protein, 1303 aa, Solanum berthaultii
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEHWLNRLERVAEDAENVFDRFRYESLKTKVVRSPLKKVSGFFSHTAFKRKMSQKINNINKELTAINKVAKDLGLQSLMVPSRKILPIRETDSFVGASDVVGRDLDVAEIKEKILKMREEDVVLSTIPIVGMGGLGKTTVAKRIYNDEHIKQIFKERIWLCIPEMSETKSFLEQILESLIERKIEVERRDIIVKKLQDELGGKKYLLVLDDLWRVDSTSWHEFVDTLRGINTSRGNCILVTTRMKRVASTVATDLHILGKLTEDHCWSIFKQKAFVDGRVPEELASMGNNIVKMCQGLPLAASALGGLLHNKEKHEWQAILDGNLLVAGEDDNGENSIKKILKLSYDYLPSPHLKQCFAYFAMFPKDYMFEKDQLIQLWMAEGFLRPSQEIPVMEDVGHRFFQILLQNSLLQDVVLDEHNNITHCKMHDLVHDLAGDILKSRLFDPKGDNGEKLSQVRYFGCESPKDQIDKIYEPERLCTLFWRSNYTSKDMLLNFKFLRVLDLSSSGIKELSAKIGKLIYLRYLDLSNTEITALPNSICELYNLQTFRVINCFSLQGLPYEMRNMISLRHIYYTSIDETSGHWGGWCLHNEHFQIPLNMGQLTSLQTLKFFKVGLEKGRQIEELGHLKNLGGELTINGLQLVCDKEEARTAYLHDKPNICKLAYLWSHDESEGCVINDEHVLDGLQPHPNLKTLAVVDYLRTKFPSWFSEESLPNLVKLKLSGSKRCKEIPSLGQLKFLRHLELIGFHELECIGPALYGVEIRNTGSNSNIQVFPSLKELVLEDMRSLIEWKGDEVGVRMSPGLEKLRITDCPLLKSIPNQFEILCELEIRGVDSEMPLLNLCSNLTSLVKLSVYDMNELTCLPDEILRNNVSLQQITIFNCGEFRELPQSLYNLHSLKRLDIYNCTNFSSLPVPNGDNYLTSLEFFFLYNCNGLISIPIGMLDQCRSLEFLHVSCCNNLVSFPLHVWEMPSFSFLDIRECPKLISVPKVGLHHLTGLLSLGIGPFSEMVDFDAFQLIFNGIQQLLSLRDLEVYGRGHWDSLPYQLMQLSNLREITIADFGIEALPPRLDNLTSLESLTLDRCKRLQHLNFSDAMPKLRLLWISDCPLVEALSDGLGNLVSLEELYLQDCEKLELLPSRDAMRRLTKLWNMGIKGCPKLEESFTNYSQWSKISHISNIELGGWRRTAISLGFSFTF

SEQ ID NO: 185 - DNA, 3912 bp, Solanum berthaultii; identical to SEQ ID NO: 181
  CDS (1)..(3912)

SEQ ID NO: 186 - protein, 1303 aa, Solanum berthaultii; identical to SEQ ID NO: 182

SEQ ID NO: 187 - DNA, 3912 bp, Solanum berthaultii; identical to SEQ ID NO: 181
  CDS (1)..(3912)

SEQ ID NO: 188 - protein, 1303 aa, Solanum berthaultii; identical to SEQ ID NO: 182

SEQ ID NO: 189 - DNA, 3912 bp, Solanum berthaultii
  CDS (1)..(3912)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcggtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttagtagttgcttctgatattgtcggtagagatttggatgttgctgagataaaggagaagattttgaagatgagagaggaggatattgttctgtccaccattcccattgtaggtatgggaggtttagggaaaacaactgtggctaagaggatttacaatgatgaacacatgaagcaaatctttaaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcaacaccctgagaggaataaatacatccagaggaaactgcattcttgtgactactcgtatgaagtgggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaagtgaagatgataatggagaaaatagcataaagaaaatcctaaaactcagctatgattatctaccatctccacatctgaaacaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttgtgttagatgaacacaacaatataacacactgtaagatgcacgatcttgtgcatgatttggctggagatatcttaaaatctagactatttgatccgaagggcgacaatggagaaaaactttctcaagttcgatactttggatgtgagtcaccaaaggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcgagctctataatttgcaaacatttagagtcatcaactgcttttcactccagggacttccatatgagatgagaaatatgataagtttgagacacatatattacacttctattgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaggaggtgaattgacaatcaatggtctccaattggtctgtgataaagaagaggctcgaacagcatatttacacgataaaccaaacatctgcaagctggcatatttatggtcccatgatgaatcagaaggctgtgtgatcaatgatgagcatgtgttggatggtcttcaaccgcatcctaacttgaaaaccttagcagtagtggactatttagggactaaatttccttcatggttcagtgaagagtcgctaccaaatttggttaagttgaaattaagtggtagcaaaaggtgcaaagaaattccatcccttggccaactgaaattccttcggcatcttgagctgataggattccatgagttggaatgcattggacctgctttatatggtgttgagattagaaataccggatcaaacagcaatatccaagtgttcccgtcattgaaagaactagtattggaggatatgcgtagccttattgagtggaagggagatgaagtcggagtaagaatgtctcccgggcttgagaagttgcggattacagactgtccattgttaaaaagtattccaaatcaatttgaaatcctctgtgaattagaaattagaggagttgacagtgaaatgccattgttgaacttgtgcagcaacttgacatctctcgtaaagcttagtgtctatgatatgaatgagctcacttgtcttccagatgagatactacgtaacaacgtttctcttcaacagataacgattttcaactgtggagagtttcgtgaattgccacaaagcttgtacaatctccattctcttaagagattagacatttacaactgcaccaacttcagttctcttcctgttcccaatggagacaactatttgacttccctcgaattctttttcttatataattgtaatggattgatcagtataccaattggaatgctagatcaatgccggtctctagagtttttgcatgtcagctgctgtaacaacttggtttcattccctttacatgtgtgggaaatgccttcattttcatttttggatataagagaatgtcccaaattgattagtgtacccaaagtgggccttcaccatctcaccgggttattgagtttgggaattggtcctttctcagagatggtggattttgatgcattccaattgatttttaatggcattcagcagttgttgtcccttcgtgatctggaggtgtacggacgtgggcactgggattctctgccctatcagcttatgcaactctctaacctaagagagatcacaatagctgatttcggaattgaggctcttcctcctagacttgacaaccttacttctcttgaaagtttgacgctagacaggtgcaaacggctacaacatctgaacttctcagatgccatgcccaaattacggcttctgtggataagtgattgtccattggtagaagctctgtcggatgggctcggcaaccttgtttctttggaagaattatatttacaggactgcgaaaaactagagcttctaccgtcccgagatgccatgcgacgcctcactaaattatggaacatgggaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 190 - protein, 1303 aa, Solanum berthaultii
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVGGFFSHTAFKRKMSQKINNINKELTAINKVAKDLGLQSLMVPSRKILPIRETDSLVVASDIVGRDLDVAEIKEKILKMREEDIVLSTIPIVGMGGLGKTTVAKRIYNDEHMKQIFKKRIWLCLPEMSETKSFLEQILESLIERKIEVERRDIIVKKLQDELGGKKYLLVLDDLWRVDSTSWHEFVNTLRGINTSRGNCILVTTRMKWVASTVATDLHILGKLTEDHCWSIFKQKAFVDGRVPEELASMGNKIVKMCQGLPLAASVLGGLLHNKEKHEWQAILDGNLLVASEDDNGENSIKKILKLSYDYLPSPHLKQCFAYFAMFPKDYMFEKDQLIQLWMAEGFLRPSQEIPVMEDVGHRFFQILLQNSLLQDVVLDEHNNITHCKMHDLVHDLAGDILKSRLFDPKGDNGEKLSQVRYFGCESPKDQIDKIYEPERLCTLFWRSNYTSKDMLLNFKFLRVLDLSSSGIKELSAKIGKLIYLRYLDLSNTEITALPNSICELYNLQTFRVINCFSLQGLPYEMRNMISLRHIYYTSIDETSGHWGGWCLHNEHFQIPLNMGQLTSLQTLKFFKVGLEKGRQIEELGHLKNLGGELTINGLQLVCDKEEARTAYLHDKPNICKLAYLWSHDESEGCVINDEHVLDGLQPHPNLKTLAVVDYLGTKFPSWFSEESLPNLVKLKLSGSKRCKEIPSLGQLKFLRHLELIGFHELECIGPALYGVEIRNTGSNSNIQVFPSLKELVLEDMRSLIEWKGDEVGVRMSPGLEKLRITDCPLLKSIPNQFEILCELEIRGVDSEMPLLNLCSNLTSLVKLSVYDMNELTCLPDEILRNNVSLQQITIFNCGEFRELPQSLYNLHSLKRLDIYNCTNFSSLPVPNGDNYLTSLEFFFLYNCNGLISIPIGMLDQCRSLEFLHVSCCNNLVSFPLHVWEMPSFSFLDIRECPKLISVPKVGLHHLTGLLSLGIGPFSEMVDFDAFQLIFNGIQQLLSLRDLEVYGRGHWDSLPYQLMQLSNLREITIADFGIEALPPRLDNLTSLESLTLDRCKRLQHLNFSDAMPKLRLLWISDCPLVEALSDGLGNLVSLEELYLQDCEKLELLPSRDAMRRLTKLWNMGIKGCPKLEESFTNYSQWSKISHISNIELGGWRRTAISLGFSFTF

SEQ ID NO: 191 - DNA, 3912 bp, Solanum berthaultii
  CDS (1)..(3912)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcggtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttagtagttgcttctgatattgtcggtagagatttggatgttgctgagataaaggagaagattttgaagatgagagaggaggatattgttctgtccaccattcccattgtaggtatgggaggtttagggaaaacaactgtggctaagaggatttacaatgatgaacacatgaagcaaatctttaaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctactcctggatgatttgtggcgtgttgactctacatcgtggcatgagttcgtcaacaccctgagaggaataaatacatccagaggaaactgcattcttgtgactactcgtatgaagtgggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaagtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgatgtgttagatgaacacaacaatataacacactgcaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagcttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggttaagttgaaattaagtggtagcaaaaggtgcaaagaaattccatcccttggccaactgaaattccttcggcatcttgagctgataggattccatgagttggaatgcattggacctgctttatatggtgttgagattagaaataccggatcaaacagcaatatccaagtgttcccgtcattgaaagaactagtattggaggatatgcgtagccttattgagtggaagggagatgaagtcggagtaagaatgtctaccgggcttgagaagttgcggattacagactgtccattgttaaaaagtattccaaatcaatttgaaatcctctgtgaattagaaattagaggagttgacagtgaaatgccattgttgaacttgtgcagcaacttgacatctctcgtaaagcttagtgtctatgatatgaatgagctcacttgtcttccagatgagatactacgtaacaacgtttctcttcaacagataacgattttcaactgtggagagtttcgtgaattgccacaaagcttgtacaatctccattctcttaagagattagacatttacaactgcaccaacttcagttctcttcctgttcccaatggagacaactatttgacttccctcgaattctttttcttatataattgtaatggattgatcagtataccaattggaatgctagatcaatgccggtctctagagtttttgcatgtcagctgctgtaacaacttggtttcattccctttacatgtgtgggaaatgccttcattttcatttttggatataagagaatgtcccaaattgattagtgtacccaaagtgggccttcaccatctcaccgggttattgagtttgggaattggtcctttctcagagatggtggattttgatgcattccaattgatttttaatggcattcagcagttgttgtcccttcgtgatctggaggtgtacggacgtgggcactgggattctctgccctatcagcttatgcaactctctaacctaagagagatcacaatagctgatttcggaattgaggctcttcctcctagacttgacaaccttacttctcttgaaagtttgacgctagacaggtgcaaacggctacaacatctgaacttctcagatgccatgcccaaattacggcttctgtggataagtgattgtccattggtagaagctctgtcggatgggctcggcaaccttgtttctttggaagaattatatttacaggactgcgaaaaactagagcttctaccgtcccgagatgccatgcgacgcctcactaaattatggaacatgggaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 192 - protein, 1303 aa, Solanum berthaultii
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVGGFFSHTAFKRKMSQKINNINKELTAINKVAKDLGLQSLMVPSRKILPIRETDSLVVASDIVGRDLDVAEIKEKILKMREEDIVLSTIPIVGMGGLGKTTVAKRIYNDEHMKQIFKKRIWLCLPEMSETKSFLEQILESLIERKIEVERRDIIVKKLQDELGGKKYLLLLDDLWRVDSTSWHEFVNTLRGINTSRGNCILVTTRMKWVASTVATDLHILGKLTEDHCWSIFKQKAFVDGRVPEELASMGNKIVKMCQGLPLAASVLGGLLHNKEKHEWQAILDGNLLVASEDDNGENSIKKILKLSYDYLPSPHLKKCFAYFAMFPKDYMFEKDQLIQLWMAEGFLRPSQEIPVMEDVGHRFFQILLQNSLLQDDVLDEHNNITHCKMHDLVHDLAGDILKSRLFDPKGDNGEKLSQVRYFGCESPTDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEAQTAYLHDKPNICKLAYLWSHDESEGCEINDEHVLDGLQPHPNLKTLAVVDYLGTKFPSWFSEESLPNLVKLKLSGSKRCKEIPSLGQLKFLRHLELIGFHELECIGPALYGVEIRNTGSNSNIQVFPSLKELVLEDMRSLIEWKGDEVGVRMSTGLEKLRITDCPLLKSIPNQFEILCELEIRGVDSEMPLLNLCSNLTSLVKLSVYDMNELTCLPDEILRNNVSLQQITIFNCGEFRELPQSLYNLHSLKRLDIYNCTNFSSLPVPNGDNYLTSLEFFFLYNCNGLISIPIGMLDQCRSLEFLHVSCCNNLVSFPLHVWEMPSFSFLDIRECPKLISVPKVGLHHLTGLLSLGIGPFSEMVDFDAFQLIFNGIQQLLSLRDLEVYGRGHWDSLPYQLMQLSNLREITIADFGIEALPPRLDNLTSLESLTLDRCKRLQHLNFSDAMPKLRLLWISDCPLVEALSDGLGNLVSLEELYLQDCEKLELLPSRDAMRRLTKLWNMGIKGCPKLEESFTNYSQWSKISHISNIELGGWRRTAISLGFSFTF

SEQ ID NO: 193 - DNA, 3912 bp, Solanum chacoense
  CDS (1)..(3912)
atgaattattgtcttccttcgagtactctacaaacaactaccaaacgaagacttactttgagaagactttgttgcaaacagctcaggaagaagactttggtgcagactgcagaggaagaggaagcaaacacaacaatggccgatcctgtaattggtgctactgttcaagttttgcttgaaaagttgatttctctcactatcgaggaagtcaacagctcaagggatttcaacaaagatctcgaaatgttgacacaaaatgtatctttaatccaagctttcattcatgatgttgaaacaccacaagagaaacaacagtctgtggaacaatggctcaacaggcttgagagagttgctgaagatgctcaaaatgtgtttgatcgattcatatatgaatctctcaaaacaaaagtggtgaggagcccattgaaaaaggtcagtggtttcttttctcatactgcttttaagagaaaaatgtctcaaaaaatcaacaacatcaataaagagttgacggctatcaataaggtagccaaagacctcggtctacaatcactcatggttccttctcggaaaatactaccaattcgagaaacagattcctttgtagttgcttctgatattgtcggtagagatttggatattgctgagataaaggagaagattttgaacatgagagaggaggatattgttctgtccaccattcccatagtaggtatgggaggtttagggaaaacaactgtggctaagaggatttacaatgatgaacacatgaagcaaatctttgaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggtgtgttgactctacatcgtggcatgagttcattgacaccttgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttctgttagatgaacacaacaatataacacactgcaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagtttgagacacatatattacacttctattgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaggaggtgaattgacaatcaatggtctccaattggtctgtgataaagaagaggctcgaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggttaagttgaaattaagtggtagcaaaaggtgcaaagaaattccatcccttggccaactgaaattccttcggcatcttgagctgataggattccatgagttggaatgcattggacctgctttatatggtgttgagattagaaataccggatcaaacagcaatatccaagtgttcccgtcattgaaagaactagtattggaggatatgcatagccttattgagtggaagggagatgaagtcggagtaagaatgtctcccgggcttgagaagttgcggattacagactgtccattgttaaaaagtattccgaatcaatttgaaatcctccgtgaattagaaattagaggagttgacagtgaaatgccattgttgaacttgtgcagcaacttgacatctctcgtaaagcttagtgtctatgatatgaatgagctcacttgtcttccagatgagatactacgtaacaacgtttctcttcaacagataacgattttcaactgtggagagtttcgtgaattgccacaaagcttgtacaatctccattctcttaagagattagacatttacaactgcaccaacttcagttctcttcctgttcccaatggagacaactatttgacttccctcgaattcttttacttatataattgtaatggattgatcagtataccaattggaatgctagatcaatgccggtctctagagtttttgcatgtcagttgctgtaacaacttggtttcattccctttacatgtgtgggaaatgccttcattttcatttttggatataagagaatgtcccaaattgattagtgtacccaaagtgggccttcaccatctcaccgggttattgagtttggcaattggtcctttctcagagatggtggattttgatgcattccaattgatttttaatggcattcagcagttgttgtcccttcgtgatctggcggtgtacggacgtgggcactgggattctctgccctatcagcttatgcaactctctaacctaagagagatcacaatagctgatttcggaattgaggctcttcctcctagacttgacaaccttacttctcttgaaagtttgacgctagagaggtgcaaacggctacaacatctgaacttctcagatgccatgcccaaattacggcttctgtggataagtgattgtccattggtagaagctctgtcggatgggctcggcaaccttgtttctttggaagaattatatttacaggactgcgaaaaactagagcttctaccgtcccgagatgccatgcgacgcctcactaaattatggaacatgggaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 194 - protein, 1303 aa, Solanum chacoense
MNYCLPSSTLQTTTKRRLTLRRLCCKQLRKKTLVQTAEEEEANTTMADPVIGATVQVLLEKLISLTIEEVNSSRDFNKDLEMLTQNVSLIQAFIHDVETPQEKQQSVEQWLNRLERVAEDAQNVFDRFIYESLKTKVVRSPLKKVSGFFSHTAFKRKMSQKINNINKELTAINKVAKDLGLQSLMVPSRKILPIRETDSFVVASDIVGRDLDIAEIKEKILNMREEDIVLSTIPIVGMGGLGKTTVAKRIYNDEHMKQIFEKRIWLCLPEMSETKSFLEQILESLIERKIEVERRDIIVKKLQDELGGKKYLLVLDDLWCVDSTSWHEFIDTLRGINTSRGNCILVTTRRKQVASTVATDLHILGKLTEDHCWSIFKQKAFVDGRVPEELASMGNKIVKMCQGLPLAASVLGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVLLDEHNNITHCKMHDLVHDLAGDILKSRLFDPKGDNGEKLSQVRYFGCESPTDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSIDETSGHWGGWCLHNEHFQIPLNMGQLTSLQTLKFFKVGLEKGRQIEELGHLKNLGGELTINGLQLVCDKEEARTAYLHDKPNICKLAYLWSHDESEGCEINDEHVLDGLQPHPNLKTLAVVDYLGTKFPSWFSEESLPNLVKLKLSGSKRCKEIPSLGQLKFLRHLELIGFHELECIGPALYGVEIRNTGSNSNIQVFPSLKELVLEDMHSLIEWKGDEVGVRMSPGLEKLRITDCPLLKSIPNQFEILRELEIRGVDSEMPLLNLCSNLTSLVKLSVYDMNELTCLPDEILRNNVSLQQITIFNCGEFRELPQSLYNLHSLKRLDIYNCTNFSSLPVPNGDNYLTSLEFFYLYNCNGLISIPIGMLDQCRSLEFLHVSCCNNLVSFPLHVWEMPSFSFLDIRECPKLISVPKVGLHHLTGLLSLAIGPFSEMVDFDAFQLIFNGIQQLLSLRDLAVYGRGHWDSLPYQLMQLSNLREITIADFGIEALPPRLDNLTSLESLTLERCKRLQHLNFSDAMPKLRLLWISDCPLVEALSDGLGNLVSLEELYLQDCEKLELLPSRDAMRRLTKLWNMGIKGCPKLEESFTNYSQWSKISHISNIELGGWRRTAISLGFSFTF

SEQ ID NO: 195 - DNA, 3912 bp, Solanum chacoense
  CDS (1)..(3912)
atgaattattgtcttccttcgagtactctacaaacaactaccaaacgaagacttactttgagaagactttgttgcatacagctcaggaagaagactttggtgcagattgcagaggaagaggaagcaaacacaacaatggccgatcctgtaattggtgctactgttcaagttttgcttgaaaagttgatttctctcactatcgaggaggtcaacagctcaagggatttcaacaaagatctcgaaatgttgacacaaaatgtatcattaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcggtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttagtagttgcttctgatattgtcggtagagatttggatgttgctgagataaaggagaagattttgaagatgagagaggaggatattgttctgtccaccattcccattgtaggtatgggaggtttagggaaaacaactgtggctaagaggatttacaatgatgaacacatgaagcaaatctttaaaaagagaatttggttgtgtctacctgaaatgtctgaaacgaagagctttcttgaacaaatcctcgaatcattgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaagaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgcattgggagggctcttacacaacaaagaaaaacatgaatggcaagcaattcttgatggcaacctccttgttactggtgaagatgataatggagaaaatagcataaagaaaatcctaaaactcagctatgattatctaccatctccacatctgaaaaaatgttttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttgtgttagatgaacacaacaatataacacactgtaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaaatataagttcttgagagttttagatttgtccagttcaggaatcaaggagttgtcaaccaaaatcgggaagctgatatacttgagatatcttgatctctcgaacactgagatcacagccttgcccaactccatttgcgagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcgaacagcatatttacacgataaaccaaacatctgcaagctggcatatttatggtcccacgatgaatcagaaggctgtgagatcaatgatgagcatgtgttggatggtcttcaaccgcatcctaacttgaaaaccatagcagtagtggactatttagggactaaatttccttcatggttccgtgaagagtcgctaccaaatttggtcaagttgaaattaagtggaagcaaaaggtgcaaagaaattccatcccttggccaactgaaattccttcggcatcttgagctgataggattccatgagttggaatgcattggacctgctttttatggtgttgagattagaaatattggatcaaacagcattattcaagtgttcccgtcattgaaagaactagtattggaggatatgcgtagccttattgagtggaagggagatgaagttggagtaagaatgtctcccgggcttgagaagttgcggattacagactgtccattgttaaaaagtattccgaatcaatttgaaatcctccgtgaattagaaattagaggagttgacagtgaaatgccattgttgaacttgtgcagcaacttgacatctctcgtgaatcttagtgtctatgatatgaaagagctcacttgtcttccagatgagatactacgtaacaacatttctcttcaacagataacgattttcgaatgtggagagtttcgtgaattgccacaaagcttgtacaatctccattctctttatagattagacatttacaactgcaccaatttcagttctcttcctgttcccaagggagacaactatttgacttccctcatattctttttcttacataattgtaatggattgatcagtataccaattggaatgctagatcaatgccggtctctagagtatttgcatgtcagctgctgtaacaacttggtttcattccctttacatgtgtgggaaattccttcattttcagttttggaaataacagaatgtcccaaattgattagtgtacccgaagtgggccttcaccatctcaccgggttattgagattgggaattggtcctttctcagagatggtggattttgatgcattccaattgatttttaatggcattcagaagttgttgtctcttcgtgatctggaggtgtacggacgtgggcactgggattctctgccctatcagcttatgcaactctctaacctaagaaagatcacaatagctgatttcggaattgaggctcttcctcctagacttgacaaccttacttctcttgaaagtttgacgctagagaggtgcaaacggctacaacatctgaacttctcagatgccatgcccaaattacggcatctgtggataagtgattgtccattgttagaagccctgtcggatgggctcggcagcattgtttctttggaagaattatatttacaggactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacaaccataagtctcggtttctctttcactttctga

SEQ ID NO: 196 - protein, 1303 aa, Solanum chacoense
MNYCLPSSTLQTTTKRRLTLRRLCCIQLRKKTLVQIAEEEEANTTMADPVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVGGFFSHTAFKRKMSQKINNINKELTAINKVAKDLGLQSLMVPSRKILPIRETDSLVVASDIVGRDLDVAEIKEKILKMREEDIVLSTIPIVGMGGLGKTTVAKRIYNDEHMKQIFKKRIWLCLPEMSETKSFLEQILESLIERKIEVERRDIIVKKLQDELGGKKYLLVLDDLWRVDSTSWHEFVDTLRRINTSRGNCILVTTRRKQVASTVATDLHILGKLTEDHCWSIFKQKAFVDGRVPEELASMGNKIVKMCQGLPLAASALGGLLHNKEKHEWQAILDGNLLVTGEDDNGENSIKKILKLSYDYLPSPHLKKCFAYFAMFPKDYMFEKDQLIQLWMAEGFLRPSQEIPVMEDVGHRFFQILLQNSLLQDVVLDEHNNITHCKMHDLVHDLAGDILKSRLFDPKGDNGEKLSQVRYFGCESPTDQIDKIYEPERLCTLFWRSNYTSKDMLLKYKFLRVLDLSSSGIKELSTKIGKLIYLRYLDLSNTEITALPNSICELYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEARTAYLHDKPNICKLAYLWSHDESEGCEINDEHVLDGLQPHPNLKTIAVVDYLGTKFPSWFREESLPNLVKLKLSGSKRCKEIPSLGQLKFLRHLELIGFHELECIGPAFYGVEIRNIGSNSIIQVFPSLKELVLEDMRSLIEWKGDEVGVRMSPGLEKLRITDCPLLKSIPNQFEILRELEIRGVDSEMPLLNLCSNLTSLVNLSVYDMKELTCLPDEILRNNISLQQITIFECGEFRELPQSLYNLHSLYRLDIYNCTNFSSLPVPKGDNYLTSLIFFFLHNCNGLISIPIGMLDQCRSLEYLHVSCCNNLVSFPLHVWEIPSFSVLEITECPKLISVPEVGLHHLTGLLRLGIGPFSEMVDFDAFQLIFNGIQKLLSLRDLEVYGRGHWDSLPYQLMQLSNLRKITIADFGIEALPPRLDNLTSLESLTLERCKRLQHLNFSDAMPKLRHLWISDCPLLEALSDGLGSIVSLEELYLQDCEKLEHLPSRDAMRRLTKLWNMRIKGCPKLEESFTNYSQWSKISHISNIELGGWRRTTISLGFSFTF

SEQ ID NO: 197 - DNA, 3912 bp, Solanum sucrense
  CDS (1)..(3912)
atgaattattgtcttccttcgagtactctacaaacaactaccaaacgaagacttactttgagaagactttgttgcaaacagctcaggaagaagactttggtgcagactgcagaggaagaggaagcaaacacaactatggccgatcctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcggtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttagtggttgcttctgatattgtcggtagagatttggatgttgctgagataaaggagaagattttgaacatgagagaggaggatattgttctgtccaccattcccattgtaggtatgggaggtttagggaaaacaactgtggctaagaggatttacaatgatgaacacatgaagcaaatctttaaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgcattgggagggctcttacacaacaaagaaaaacatgaatggcaagcaattcttgatggcaacctccttgttgctggtgaagatgataatggagaaaatagcataaagaaaatcctaaaactcagctatgattatctaccatctccacatctgaaaaaatgttttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttgtgttagatgaacacaactatataacacactgtaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaaatataagttcttgagagttttagatttgtccagttcaggaatcaaggagttgtcaaccaaaatcgggaagctgatatacttgagatatcttgatctctcgaacactgagatcacagccttgcccaactccatttgcgagctctataatttgcaaacatttagagtcatcaactgcttttcactccaggaacttccatatgagatgagaaatatgataagtttgagacacatatattacacttctgttgacaaaagaactctgcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcgaacagcatatttacacgataaaccaaacatctgcaagctggcatatttatggtcccacgatgaatcagaaggctgtgagatcaatgatgagcatgtgttggatggtcttcaaccgcatcctaacttgaaaaccttagcagtagtggactatttagggactaaatttccttcatggttccgtgaagagtcgctaccaaatttggtcaagttgaaattaagtggaagcaaaaggtgcaaagaaattccatcccttggccaactgaaattccttcggcatcttgagctgataggattccatgagttggaatgcattggacctgctttttatggtgttgagattagaaatattggatcaaacagcattattcaagtgttcccgtcattgaaagaactagtattggaggatatgcgtagccttattgagtggaagggagatgaagttggagtaagaatgtctcccgggcttgagaagttgcggattacagactgtccattgttaaaaagtattccgaatcaatttgaaatcctccgtgaattagaaattagaggagttgacagtgaaatgccattgttgaacttgtgcagcaacttgacatctctcgtgaatcttagtgtctatgatatgaaagagctcacttgtcttccagatgagatactatgtaacaacatttctcttcaacagataacgattttcgaatgtggagagtttcgtgaattgccacaaagcttgtacaatctccattctctttatagattagacatttacaactgcaccaatttcagttctcttcctgttcccaagggagacaactatttgacttccctcatattctttttcttacataattgtaatggattgatcagtataccaattggaatgctagatcaatgccggtctctagagtatttgcatgtcagctgctgtaacaacttggtttcattccctttacatgtgtgggaaattccttcattttcagttttggaaataacagaatgtcccaaattgattagtgtacccgaagtgggccttcaccatctcaccgggttattgagattgggaattggtcctttctcagagatggtggattttgatgcattccaattgatttttaatggcattcagaagttgttgtctcttcgtgatctggaggtgtacggacgtgggcactgggattctctgccctatcagattatgcaactctctaacctaagaaagatcacaatagctgatttcggaattgaggctcttcctcctagacttgacaaccttacttctcttgaaagtttgacgctagagaggtgcaaacggctacaacatctgaacttctcagatgccatgcccaaattacggcatctgtggataagtgattgtccattgttagaagccctgtcggatgggctcggcaacattgtttctttggaagaattatatttacaggactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacaaccataagtctcggtttctctttcactttctga

SEQ ID NO: 198 - protein, 1303 aa, Solanum sucrense
MNYCLPSSTLQTTTKRRLTLRRLCCKQLRKKTLVQTAEEEEANTTMADPVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVGGFFSHTAFKRKMSQKINNINKELTAINKVAKDLGLQSLMVPSRKILPIRETDSLVVASDIVGRDLDVAEIKEKILNMREEDIVLSTIPIVGMGGLGKTTVAKRIYNDEHMKQIFKKRIWLCLPEMSETKSFLEQILESLIERKIEVERRDIIVKKLQDELGGKKYLLVLDDLWRVDSTSWHEFVDTLRGINTSRGNCILVTTRRKQVASTVATDLHILGKLTEDHCWSIFKQKAFVDGRVPEELASMGNKIVKMCQGLPLAASALGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVVLDEHNYITHCKMHDLVHDLAGDILKSRLFDPKGDNGEKLSQVRYFGCESPTDQIDKIYEPERLCTLFWRSNYTSKDMLLKYKFLRVLDLSSSGIKELSTKIGKLIYLRYLDLSNTEITALPNSICELYNLQTFRVINCFSLQELPYEMRNMISLRHIYYTSVDKRTLHWGGWCLHNEHFQIPLNMGQLTSLQTLKFFKVGLEKGRQIEELGHLKNLRGELTINGLQLVCDKEEARTAYLHDKPNICKLAYLWSHDESEGCEINDEHVLDGLQPHPNLKTLAVVDYLGTKFPSWFREESLPNLVKLKLSGSKRCKEIPSLGQLKFLRHLELIGFHELECIGPAFYGVEIRNIGSNSIIQVFPSLKELVLEDMRSLIEWKGDEVGVRMSPGLEKLRITDCPLLKSIPNQFEILRELEIRGVDSEMPLLNLCSNLTSLVNLSVYDMKELTCLPDEILCNNISLQQITIFECGEFRELPQSLYNLHSLYRLDIYNCTNFSSLPVPKGDNYLTSLIFFFLHNCNGLISIPIGMLDQCRSLEYLHVSCCNNLVSFPLHVWEIPSFSVLEITECPKLISVPEVGLHHLTGLLRLGIGPFSEMVDFDAFQLIFNGIQKLLSLRDLEVYGRGHWDSLPYQIMQLSNLRKITIADFGIEALPPRLDNLTSLESLTLERCKRLQHLNFSDAMPKLRHLWISDCPLLEALSDGLGNIVSLEELYLQDCEKLEHLPSRDAMRRLTKLWNMRIKGCPKLEESFTNYSQWSKISHISNIELGGWRRTTISLGFSFTF

SEQ ID NO: 199 - DNA, 3915 bp, Solanum tarijense
  CDS (1)..(3915)
atgaattattgtcttccttcgagtactctacaaacaactcccaaaagaaaacttactttgagaagactttggtgcaaacagctcaggaagaagactttggtgcagactgcagaggaagaggaagcaaacacaactatggccgatcctgtaattggtgctactgttcaagttttgcttgaaaagttgatttctctcactatcgaggacgtcaacagctcaagggatttcaacaaagatctcgaaatgttgacacaaaatgtatccttaatccaagctttcattcatgatgttaaaacaccacaagttgagaaacaacagtctttcgaacaatggctcaacaggcttgagagagttgctgaagatgctcaaaatgtgtttgatcgattcagatatgaatctctcaaaacaaaagtggtgaggagcccattgaaaaaggtcagtggtttcttttctcattctgcttttaagagaaaaatgtctcaaaatatcaacaacataaataaagagttgacggctatcaataaggtagccaaagacctcggtctacaatcactcatggtaccttctcggaaaatactaccaattcgagaaacagattccttcgtaggtgcttctgatgttgttggtagagatttggatgttgctgagataaaggagaagattttgaagatgagagaggaggatgttgttctgtccaccattcccatagtaggtatgggaggtttagggaaaacaactgtggctaagaggatttacaatgatgaacacatcaagcaaatctttaaagagagaatttggttgtgtatacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgctggtgaagatgataatggagaaaatagcataaagaaaatcctaaaactcagctatgattatctaccatctccacatctgaaaaaatgttttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttgtgttagatgaacacaacaatataacacactgtaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaaatataagttcttgagagttttagatttgtccagttcaggaatcaaggagttgtcaaccaaaatcgggaagctgatatacttgagatatcttgatctctcgaacactgaaatcacagccttgcccaactccatttgcgagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggcttgaacagcatatttacacgataaaccaaacatctgcaagctggcatatttatggtcccacgatgaatcagaaggctgtgagatcaatgatgagcatgtgttggatggtcttcaaccgcatcctaacttgaaaaccatagcagtagtggactatttagggactaaatttccttcatggttccgtgaagagtcgctaccaaatttggtcaagttgaaattaagtggaagcaaaaggtgcaaagaaattccatcccttggccaactgaaattccttcggcatcttgagctgataggattccatgagttggaatgcattggacctgctttttatggtgttgagattagaaatattggatcaaacagcattattcaagtgttcccgtcattgaaagaactagtattggaggatatgcgtagccttattgagtggaagggagatgaagttggagtaagaatgtctcccgggcttgagaagttgcggattacagactgtccattgttaaaaagtattccgaatcaatttgaaatcctccgtgaattagaaattagaggagttgacagtgaaatgccattgttgaacttgtgcagcaacttgacatctctcgtgaatcttagtgtctatgatatgaaagagctcacttgtcttccagatgagatactacgtaacaacatttctcttcaacagataacgattttcgaatgtggagagtttcgtgaattgccacaaagcttgtacaatctccattctctttatagattagacatttacaactgcaccaatttcagttctcttcctgttcccaagggagacaactatttgacttccctcatattctttttcttacataattgtaatggattgatcagtataccaattggaatgctagatcaatgccggtctctagagtatttgcatgtcagctgctgtaacaacttggtttcattccctttacatgtgtgggatattccttcattttcagttttggaaataacagaatgtcccaaattgattagtgtacccgaagtgggccttcaccatctcaccgggttattgagattgggaattggtcctttctcagagatggtggattttgatgcattccaattgatttttaatggcattcagaagttgttgtctcttcgtgatctggaggtgtacggacgtgggcactgggattctctgccctatcagcttatgcaactctctaacctaagaaagatcacaatagctgatttcggaattgaggctcttcctcctagacttgacaaccttacttctcttgaaagtttgacgctagagaggtgcaaacggctacaacatctgaacttctcagatgccatgcccaaattacggcatctgtggataagtgattgtccattgttagaagccctgtcggatgggctcggcaacattgtttctttggaagaattatatttacaggactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacaaccataagtctcggtttctctttcactttctga

SEQ ID NO: 200 - protein, 756 aa, Solanum tarijense
MNYCLPSSTLQTTPKRKLTLRRLWCKQLRKKTLVQTAEEEEANTTMADPVIGATVQVLLEKLISLTIEDVNSSRDFNKDLEMLTQNVSLIQAFIHDVKTPQVEKQQSFEQWLNRLERVAEDAQNVFDRFRYESLKTKVVRSPLKKVSGFFSHSAFKRKMSQNINNINKELTAINKVAKDLGLQSLMVPSRKILPIRETDSFVGASDVVGRDLDVAEIKEKILKMREEDVVLSTIPIVGMGGLGKTTVAKRIYNDEHIKQIFKERIWLCIPEMSETKSFLEQILESLIERKIEVERRDIIVKKLQDELGGKKYLLVLDDLWRVDSTSWHEFVDTLRGINTSRGNCILVTTRRKQVASTVATDLHILGKLTEDHCWSIFKQKAFVDGRVPEELASMGNKIVKMCQGLPLAASVLGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVVLDEHNNITHCKMHDLVHDLAGDILKSRLFDPKGDNGEKLSQVRYFGCESPTDQIDKIYEPERLCTLFWRSNYTSKDMLLKYKFLRVLDLSSSGIKELSTKIGKLIYLRYLDLSNTEITALPNSICELYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEA

SEQ ID NO: 201 - protein, 547 aa, Solanum tarijense
TAYLHDKPNICKLAYLWSHDESEGCEINDEHVLDGLQPHPNLKTIAVVDYLGTKFPSWFREESLPNLVKLKLSGSKRCKEIPSLGQLKFLRHLELIGFHELECIGPAFYGVEIRNIGSNSIIQVFPSLKELVLEDMRSLIEWKGDEVGVRMSPGLEKLRITDCPLLKSIPNQFEILRELEIRGVDSEMPLLNLCSNLTSLVNLSVYDMKELTCLPDEILRNNISLQQITIFECGEFRELPQSLYNLHSLYRLDIYNCTNFSSLPVPKGDNYLTSLIFFFLHNCNGLISIPIGMLDQCRSLEYLHVSCCNNLVSFPLHVWDIPSFSVLEITECPKLISVPEVGLHHLTGLLRLGIGPFSEMVDFDAFQLIFNGIQKLLSLRDLEVYGRGHWDSLPYQLMQLSNLRKITIADFGIEALPPRLDNLTSLESLTLERCKRLQHLNFSDAMPKLRHLWISDCPLLEALSDGLGNIVSLEELYLQDCEKLEHLPSRDAMRRLTKLWNMRIKGCPKLEESFTNYSQWSKISHISNIELGGWRRTTISLGFSFTF

SEQ ID NO: 202 - DNA, 3912 bp, Solanum berthaultii
  CDS (1)..(3912)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcagtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttagtagttgcttctgatattgtcggtagagatttggatgttgctgagataaaggagaagattttgaagatgagagaggaggatattgttctgtccaccattcccattgtaggtatgggaggtttagggaaaacaactgtggctaagaggatttacaatgatgaacacatgaagcaaatctttaaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggagtgttgactctacattgtggcatgagttcgtcgacaccctgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgcgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaaggatttcttcgtccaagtcaagagatccctgtgatggaagacgttgggcacaggttttttcaaatcttgttgcagaattccttgctacaagatgttgtgttagatgaacacaacaatataacacactgtaagatgcacgatcttgtgcatgatttggctggacatatcttaaaatctagactatttgatccgaagggcgacgatggagaaaaactttctcaagttcgatactttggatgtgagtcaccaacggatcaaatagataagatatgtgagccagaacgtttgtgcacactgttttggagaagcaattatacatctgaagatatgctgttgaactttaagttcttgagagttttagatttgtccagttcaggaatcaaggagttgtcagccaaaatcgggaagctgatatacttgagataccttgatctctcgaacactgagatcacagccttgcccaactccatttgcgagctctataatttgcaaacatttagagtcatcaactgcttttcactccagaaacttccatatgagatgggaaatatggtaagtttgagacacatatattacacttctgttgacaaaagaaatgagcattggggaggatggtgtattctcaatgaacgttttcagatgtcacttaagatgcgacaattgacttgtcttcaaaccctcaagtttttcaagataggtttaaagaaaggtcgtcaaatagaagaattaggtcatttgaaaaacctaagaggtgaattgacgatcaatggtctccaattggtctgtgataaagaagaggctcgaacagcttatttacacgataaaccaaacatctgcaagctggcatttttatggtcccatgatgaatcagaaggctctgagatcaatgatgagcatgtgttggatggtcttcaaccgcatcctaacttgaaaaccttagcagtagtggactatttagggactaaatttccttcatggttccatgaagagtcgctaccaaatttggtcaagttgaaattaagtggtagcaaaaggtgcaaagaaattccatcccttggccaactgaaattccttcggcatcttgagctgataggattccatgagttggaatgcattggacctgctttttatggtgttgagattagaaatattggatcaaacaacattattcaagtgttcccgtcattgaaagaactagtattggaggatatgcgtagccttattgagtggaagggagatgaagttggagtaagaatgtctcccgggcttgagaagttgcggattacagactgtccattgttaaaaagtattccgaatcaatttgaaatcctccgtgaattagaaattagaggagttgacagtgaaatgccattgttgaacttgtgcagcaacttgacatctctcgtgaatcttagtgtctatgatatgaaagagctcacttgtcttccagatgagatactacgtaacaacatttctcttcaacagataacgattttcaactgcggagagtttcgtgaattgccacaaagcttgtacaatctccattctctttatagattagacatttacaactgcaccaatttcagttctcttcctgttcccaagggagacaactatttgacttccctcatattctttttcttacataattgtaatggattgatcagtataccaattggaatgctagatcaatgccggtctctagagtatttgcatgtcagctgctgtaacaacttggtttcattccctttacatgtgtgggaaattccttcattttcagttttggaaataacagaatgtcccaaattgattagtgtacccgaagtgggccttcaccatctcaccgggttattgagattgggaattggtcctttctcagagatggtggattttgatgcattccaattgatttttaatggcattcagaagttgttgtctcttcgtgatctggaggtgtacggacgtgggcactgggattctctgccctatcagcttatgcaactctctaacctaagaaagatcacaatagctgatttcggaattgaggctcttcctcctagacttgacaaccttacttctcttgaaagtttgacgctagagaggtgcaaacggctacaacatctgaacttctcagatgccatgcccaaattacggcttctgtggataagtgattgtccattgttagaagccctgtcggatgggctcggcaacattgtttctttggaagaattatatttacaggactgcgaaaaactagagcatctaccgtcccgagatgccatgcgacgcctcactaaattatggaacatgagaattaaaggatgcccaaagttagaagaaagtttcatcaactactcccagtggtccaaaatttcccatatttcaaatattgaattaggtgggtggagaaggacagccataagtctcggtttctctttcactttctga

SEQ ID NO: 203 - protein, 1303 aa, Solanum berthaultii
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVSGFFSHTAFKRKMSQKINNINKELTAINKVAKDLGLQSLMVPSRKILPIRETDSLVVASDIVGRDLDVAEIKEKILKMREEDIVLSTIPIVGMGGLGKTTVAKRIYNDEHMKQIFKKRIWLCLPEMSETKSFLEQILESLIERKIEVERRDIIVKKLQDELGGKKYLLVLDDLWSVDSTLWHEFVDTLRGINTSRGNCILVTTRRKQVASTVATDLHILGKLTEDHCWSIFKQKAFVDGRVPEELASMGNKIVKMCQGLPLAASALGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVVLDEHNNITHCKMHDLVHDLAGHILKSRLFDPKGDDGEKLSQVRYFGCESPTDQIDKICEPERLCTLFWRSNYTSEDMLLNFKFLRVLDLSSSGIKELSAKIGKLIYLRYLDLSNTEITALPNSICELYNLQTFRVINCFSLQKLPYEMGNMVSLRHIYYTSVDKRNEHWGGWCILNERFQMSLKMRQLTCLQTLKFFKIGLKKGRQIEELGHLKNLRGELTINGLQLVCDKEEARTAYLHDKPNICKLAFLWSHDESEGSEINDEHVLDGLQPHPNLKTLAVVDYLGTKFPSWFHEESLPNLVKLKLSGSKRCKEIPSLGQLKFLRHLELIGFHELECIGPAFYGVEIRNIGSNNIIQVFPSLKELVLEDMRSLIEWKGDEVGVRMSPGLEKLRITDCPLLKSIPNQFEILRELEIRGVDSEMPLLNLCSNLTSLVNLSVYDMKELTCLPDEILRNNISLQQITIFNCGEFRELPQSLYNLHSLYRLDIYNCTNFSSLPVPKGDNYLTSLIFFFLHNCNGLISIPIGMLDQCRSLEYLHVSCCNNLVSFPLHVWEIPSFSVLEITECPKLISVPEVGLHHLTGLLRLGIGPFSEMVDFDAFQLIFNGIQKLLSLRDLEVYGRGHWDSLPYQLMQLSNLRKITIADFGIEALPPRLDNLTSLESLTLERCKRLQHLNFSDAMPKLRLLWISDCPLLEALSDGLGNIVSLEELYLQDCEKLEHLPSRDAMRRLTKLWNMRIKGCPKLEESFINYSQWSKISHISNIELGGWRRTAISLGFSFTF

SEQ ID NO: 204 - DNA, 3909 bp, Solanum chacoense
  CDS (1)..(3909)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtggaacaatggctcaacaggcttgagagagttgctgaagatgctgaaaatgtgtttgatcgattcagatatgaatctctcaaaacaaaagtggtgaggagcccattgaaaaaggtcagtggtttcttttctcatactgcttttaagagaaaaatgtctcaaaaaatcaacaacataaataaagagttgacggctatcaataaggtagccaaagacctcggtctacaatcactcatggtaccttcttggaaaatactaccaattcgagaaacagattccttcgtaggtgcttctgatgttgttggtagagatttggatgttgctgagataaaggagaagattttgaacatgagagaggaggatgttgttctgtccaccattcccatagtaggtatgggaggtctagggaaaacaactgtggctaagaggatttacaatgatgaacacatcaagcaaatctttaaagagagaatttggttgtgtatacctgaaatgtctgaaacgaagagctttcttcaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttctgttagatgaacacaacaatataacacactgcaagatgcacgatcttgtgcatgatttggctggagatatcttaaaatctagactatttgatccgaagggcaacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggtcgagttgaaattaagtggtagcaaaaggtgcaaagaaattccatcccttggccaactgaaattccttcggcatcttgagctggtaggattccatgagttggaatgcattggacctgctttttatggtgttgagatgagaaatattggatcaaacagcattatccaagtgttcccgtcattgaaaaaactagtattgaaggatatgcgtagccttattgagtggaagggagatgaagttggagtaagaatgtctcccggtcttgagaagttgcggattacagactgtccattgttaaaaagtattccgaatcaatttgaaatcctccgtcaattaaaaattacaggagttgacagtgaaatgccattgttgaacttgtgcagcaacttgacatctctcgtaaagcttagagtctatgatatgaaagagctcacttgtcttccagatgagatgctacgtaacaacgtttctcttcaacagataataattttcaactgcggagagtttcgtgaattgccacaaagcttgtacaatctccattctcttaggagattagacatttacaactgcaccaatttcagttctcttcctgttcccaatggaggcaactatttgacttccctcgaattcttttgcttatataattgtaatggattgatcagtataccaattggaatgctagatcaatgccggctagtgtttttgaatgtcagctgctgtaacaacttggtttcattccctgtacatgtgtgggaaatgccttcactttcatatttggttatatcagaatgtcccaaattgattagtgtacccaaagtgggccttcaccatctcaccgggttagtgagattgggaattggtcctttctcagagatggtggattttgatgcattccaattgatttttaatggcattcagcagttgttgtcccttcgtgatctggaggtgtacggacgtgggcactgggattctctgccctatcagcttatgcaactctctgacctaagagagatcacaatagctgatttcggaattgaggctcttcctcctactcttgacaaccttacttctcttgaaagtttgacgctagtgaggtgcaaacagctacaacatctgaacttctcagatgccatgcccaaattacggctcctgtggatacgtgattgtccattgttagaagctctgtcggatgggctcggcaaccttgtttctttggaagaattatatttacatgactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 205 - protein, 1302 aa, Solanum chacoense
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVSGFFSHTAFKRKMSQKINNINKELTAINKVAKDLGLQSLMVPSWKILPIRETDSFVGASDVVGRDLDVAEIKEKILNMREEDVVLSTIPIVGMGGLGKTTVAKRIYNDEHIKQIFKERIWLCIPEMSETKSFLQQILESLIERKIEVERRDIIVKKLQDELGGKKYLLVLDDLWRVDSTSWHEFVDTLRGINTSRGNCILVTTRRKQVASTVATDLHILGKLTEDHCWSIFKQKAFVDGRVPEELASMGNKIVKMCQGLPLAASVLGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVLLDEHNNITHCKMHDLVHDLAGDILKSRLFDPKGNNGEKLSQVRYFGCESPTDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEAQTAYLHDKPNICKLAYLWSHDESEGCEINDEHVLDGLQPHPNLKTLAVVDYLGTKFPSWFSEESLPNLVELKLSGSKRCKEIPSLGQLKFLRHLELVGFHELECIGPAFYGVEMRNIGSNSIIQVFPSLKKLVLKDMRSLIEWKGDEVGVRMSPGLEKLRITDCPLLKSIPNQFEILRQLKITGVDSEMPLLNLCSNLTSLVKLRVYDMKELTCLPDEMLRNNVSLQQIIIFNCGEFRELPQSLYNLHSLRRLDIYNCTNFSSLPVPNGGNYLTSLEFFCLYNCNGLISIPIGMLDQCRLVFLNVSCCNNLVSFPVHVWEMPSLSYLVISECPKLISVPKVGLHHLTGLVRLGIGPFSEMVDFDAFQLIFNGIQQLLSLRDLEVYGRGHWDSLPYQLMQLSDLREITIADFGIEALPPTLDNLTSLESLTLVRCKQLQHLNFSDAMPKLRLLWIRDCPLLEALSDGLGNLVSLEELYLHDCEKLEHLPSRDAMRRLTKLWNMRIKGCPKLEESFTNYSQWSKISHISNIELGGWRRTAISLGFSFTF

SEQ ID NO: 206 - DNA, 3909 bp, Solanum berthaultii
  CDS (1)..(3909)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtggaacaatggctcaacaggcttgagagagttgctgaagatgctgaaaatgtgtttgatcgattcagatatgaatctctcaaaacaaaagtggtgaggagcccattgaaaaaggtcagtggtttcttttctcatactgcttttaagagaaaaatgtctcaaaaaatcaacaacataaataaagagttgacggctatcaataaggtagccaaagacctcggtctacaatcactcatggtaccttcttggaaaatactaccaattcgagaaacagattccttcgtaggtgcttctgatgttgttggtagagatttggatgttgctgagataaaggagaagattttgaacatgagagaggaggatgttgttctgtccaccattcccatagtaggtatgggaggtttagggaaaacaactgtggctaagaggatttacaatgatgaacacatcaagcaaatctttaaagagagaatttggttgtgtatacctgaaatgtctgaaacgaagagctttcttcaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttctgttagatgaacacaacaatataacacactgcaagatgcacgatcttgtgcatgatttggctggagatatcttaaaatctagactatttgatccgaagggcaacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggtcgagttgaaattaagtggtagcaaaaggtgcaaagaaattccatcccttggccaactgaaattccttcggcatcttgagctggtaggattccatgagttggaatgcattggacctgctttttatggtgttgagatgagaaatattggatcaaacagcattatccaagtgttcccgtcattgaaaaaactagtattgaaggatatgcgtagccttattgagtggaagggagatgaagttggagtaagaatgtctcccggtcttgagaagttgcggattacagactgtccattgttaaaaagtattccgaatcaatttgaaatcctccgtcaattaaaaattacaggagttgacagtgaaatgccattgttgaacttgtgcagcaacttgacatctctcgtaaagcttagagtctatgatatgaaagagctcacttgtcttccagatgagatgctacgtaacaacgtttctcttcaacagataataattttcaactgcggagagtttcgtgaattgccacaaagcttgtacaatctccattctcttaggagattagacatttacaactgcaccaatttcagttctcttcctgttcccaatggaggcaactatttgacttccctcgaattcttttgcttatataattgtaatggattgatcagtataccaattggaatgctagatcaatgccggctagtgtttttgaatgtcagctgctgtaacaacttggtttcattccctgtacatgtgtgggaaatgccttcactttcatatttggttatatcagaatgtcccaaattgattagtgtacccaaagtgggccttcaccatctcaccgggttagtgagattgggaattggtcctttctcagagatggtggattttgatgcattccaattgatttttaatggcattcagcagttgttgtcccttcgtgatctggaggtgtacggacgtgggcactgggattctctgccctatcagcttatgcaactctctgacctaagagagatcacaatagctgatttcggaattgaggctcttcctcctactcttgacaaccttacttctcttgaaagtttgacgctagtgaggtgcaaacagctacaacatctgaacttctcagatgccatgcccaaattacggctcctgtggatacgtgattgtccattgttagaagctctgtcggatgggctcggcaaccttgtttctttggaagaattatatttacatgactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 207 - protein, 1302 aa, Solanum berthaultii; identical to SEQ ID NO: 205

SEQ ID NO: 208 - DNA, 3909 bp, Solanum berthaultii
  CDS (1)..(3909)
  misc_feature (738)..(738): The 'Xaa' at location 738 stands for Gly, or Arg.
  misc_feature (742)..(742): The 'Xaa' at location 742 stands for Thr.
  misc_feature (756)..(756): The 'Xaa' at location 756 stands for Arg, or Gln.
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtggaacaatggctcaacaggcttgagagagttgctgaagatgctgaaaatgtgtttgatcgattcagatatgaatctctcaaaacaaaagtggtgaggagcccattgaaaaaggtcagtggtttcttttctcatactgcttttaagagaaaaatgtctcaaaaaatcaacaacataaataaagagttgacggctatcaataaggtagccaaagacctcggtctacaatcactcatggtaccttcttggaaaatactaccaattcgagaaacagattccttcgtaggtgcttctgatgttgttggtagagatttggatgttgctgagataaaggagaagattttgaacatgagagaggaggatgttgttctgtccaccattcccatagtaggtatgggaggtttagggaaaacaactgtggctaagaggatttacaatgatgaacacatcaagcaaatctttaaagagagaatttggttgtgtatacctgaaatgtctgaaacgaagagctttcttcaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttctgttagatgaacacaacaatataacacactgcaagatgcacgatcttgtgcatgatttggctggagatatcttaaaatctagactatttgatccgaagggcaacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctargaggtgaattgacratcaatggtctccaattggtctgtgataaagaagaggctcraacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggtcgagttgaaattaagtggtagcaaaaggtgcaaagaaattccatcccttggccaactgaaattccttcggcatcttgagctggtaggattccatgagttggaatgcattggacctgctttttatggtgttgagatgagaaatattggatcaaacagcattatccaagtgttcccgtcattgaaaaaactagtattgaaggatatgcgtagccttattgagtggaagggagatgaagttggagtaagaatgtctcccggtcttgagaagttgcggattacagactgtccattgttaaaaagtattccgaatcaatttgaaatcctccgtcaattaaaaattacaggagttgacagtgaaatgccattgttgaacttgtgcagcaacttgacatctctcgtaaagcttagagtctatgatatgaaagagctcacttgtcttccagatgagatgctacgtaacaacgtttctcttcaacagataataattttcaactgcggagagtttcgtgaattgccacaaagcttgtacaatctccattctcttaggagattagacatttacaactgcaccaatttcagttctcttcctgttcccaatggaggcaactatttgacttccctcgaattcttttgcttatataattgtaatggattgatcagtataccaattggaatgctagatcaatgccggctagtgtttttgaatgtcagctgctgtaacaacttggtttcattccctgtacatgtgtgggaaatgccttcactttcatatttggttatatcagaatgtcccaaattgattagtgtacccaaagtgggccttcaccatctcaccgggttagtgagattgggaattggtcctttctcagagatggtggattttgatgcattccaattgatttttaatggcattcagcagttgttgtcccttcgtgatctggaggtgtacggacgtgggcactgggattctctgccctatcagcttatgcaactctctgacctaagagagatcacaatagctgatttcggaattgaggctcttcctcctactcttgacaaccttacttctcttgaaagtttgacgctagtgaggtgcaaacagctacaacatctgaacttctcagatgccatgcccaaattacggctcctgtggatacgtgattgtccattgttagaagctctgtcggatgggctcggcaaccttgtttctttggaagaattatatttacatgactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 209 - protein, 1302 aa, Solanum berthaultii
  misc_feature (738)..(738): The 'Xaa' at location 738 stands for Gly, or Arg.
  misc_feature (742)..(742): The 'Xaa' at location 742 stands for Thr.
  misc_feature (756)..(756): The 'Xaa' at location 756 stands for Arg, or Gln.
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVSGFFSHTAFKRKMSQKINNINKELTAINKVAKDLGLQSLMVPSWKILPIRETDSFVGASDVVGRDLDVAEIKEKILNMREEDVVLSTIPIVGMGGLGKTTVAKRIYNDEHIKQIFKERIWLCIPEMSETKSFLQQILESLIERKIEVERRDIIVKKLQDELGGKKYLLVLDDLWRVDSTSWHEFVDTLRGINTSRGNCILVTTRRKQVASTVATDLHILGKLTEDHCWSIFKQKAFVDGRVPEELASMGNKIVKMCQGLPLAASVLGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVLLDEHNNITHCKMHDLVHDLAGDILKSRLFDPKGNNGEKLSQVRYFGCESPTDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLXGELXINGLQLVCDKEEAXTAYLHDKPNICKLAYLWSHDESEGCEINDEHVLDGLQPHPNLKTLAVVDYLGTKFPSWFSEESLPNLVELKLSGSKRCKEIPSLGQLKFLRHLELVGFHELECIGPAFYGVEMRNIGSNSIIQVFPSLKKLVLKDMRSLIEWKGDEVGVRMSPGLEKLRITDCPLLKSIPNQFEILRQLKITGVDSEMPLLNLCSNLTSLVKLRVYDMKELTCLPDEMLRNNVSLQQIIIFNCGEFRELPQSLYNLHSLRRLDIYNCTNFSSLPVPNGGNYLTSLEFFCLYNCNGLISIPIGMLDQCRLVFLNVSCCNNLVSFPVHVWEMPSLSYLVISECPKLISVPKVGLHHLTGLVRLGIGPFSEMVDFDAFQLIFNGIQQLLSLRDLEVYGRGHWDSLPYQLMQLSDLREITIADFGIEALPPTLDNLTSLESLTLVRCKQLQHLNFSDAMPKLRLLWIRDCPLLEALSDGLGNLVSLEELYLHDCEKLEHLPSRDAMRRLTKLWNMRIKGCPKLEESFTNYSQWSKISHISNIELGGWRRTAISLGFSFTF

SEQ ID NO: 210 - DNA, 3912 bp, Solanum tarijense
  CDS (1)..(3912)
atgaattattgtcttccttcgagtactctacaaacaactcccaaaagaaaacttactttgagaagactttggtgcaaacagctcaggaagaagactttggtgcagactgcagaggaagaggaagcaaacacaactatggccgatcctgtaattggtgctactgttcaagttttgcttgaaaagttgatttctctcactatcgaggacgtcaacagctcaagggatttcaacaaagatctcgaaatgttgacacaaaatgtatccttaatccaagctttcattcatgatgttaaaacaccacaagttgagaaacaacagtctttcgaacaatggctcaacaggcttgagagagttgctgaagatgctcaaaatgtgtttgatcgattcagatatgaatctctcaaaacaaaagtggtgaggagcccattgaaaaaggtcagtggtttcttttctcattctgcttttaagagaaaaatgtctcaaaatatcaacaacataaataaagagttgacggctatcaataaggtagccaaagacctcggtctacaatcactcatggtaccttctcggaaaatactaccaattcgagaaacagattccttcgtaggtgcttctgatgttgttggtagagatttggatgttgctgagataaaggagaagattttgaagatgagagaggaggatgttgttctgtccaccattcccatagtaggtatgggaggtttagggaaaacaactgtggctaagaggatttacaatgatgaacacatcaagcaaatctttaaagagagaatttggttgtgtatacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttctgttagatgaacacaacaatataacacactgcaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcacttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggtcaagttgaaattaagtggtagcaaaaggtgcaaagaaattccatcccttggccaactgaaattccttcggcatcttgagctgataggattccatgagttggaatgcattggacctgctttttatggtgttgagatgagaaatattggatcaaacagcattatccaagtgttcccgtcattgaaaaaactagtattgaaggatatgcgtagccttattgagtggaagggagatgaagttggagtaagaatgtctcccggtcttgagaagttgcggattacagactgtccattgttaaaaagtattccgaatcaatttgaaatcctccgtcaattaaaaattacaggagttgacagtgaaatgccattgttgaacttgtgcagcaacttgacatctctcgtaaagcttagagtctatgatatgaaagagctcacttgtcttccagatgagatgctacgtaacaacgtttctcttcaacagataataattttcaactgcggagagtttcgtgaattgccacaaagcttgtacaatctccattctcttaggagattagacatttacaactgcaccaatttcagttctcttcctgttcccaatggagacaactatttgacttccctcgaattcttttgcttacataattgtaatggattgatcagtataccagttggaatgctagatcaatgccggctagtgtttttgaatgtcagctgctgtaacaacttggtttcattccctgtacatgtgtgggaaatgccttcactttcatatttggttatatcagaatgtcccaaattgattagtgtacccaaagtgggccttcaccatctcaccgggttagtgagattgggaattggtcctttctcagagatggtggattttgatgcattccaattgatttttaatggcattcagcagttgttgtcccttcgtgatctggaggtgtacggacgtgggcactgggattctctgccctatcagcttatgcaactctctgacctaagagagatcacaatagctgatttcggaattgaggctcttcctcctactcttgacaaccttacttctcttgaaagtttgacgctagtgaggtgcaaacagctacaacatctgaacttctcagatgccatgcccaaattacggctcctgtggatacgtgattgtccattgttagaagctctgtcggatgggctcggcaaccttgtttctttggaagaattatatttacatgactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 211 - protein, 1303 aa, Solanum tarijense
MNYCLPSSTLQTTPKRKLTLRRLWCKQLRKKTLVQTAEEEEANTTMADPVIGATVQVLLEKLISLTIEDVNSSRDFNKDLEMLTQNVSLIQAFIHDVKTPQVEKQQSFEQWLNRLERVAEDAQNVFDRFRYESLKTKVVRSPLKKVSGFFSHSAFKRKMSQNINNINKELTAINKVAKDLGLQSLMVPSRKILPIRETDSFVGASDVVGRDLDVAEIKEKILKMREEDVVLSTIPIVGMGGLGKTTVAKRIYNDEHIKQIFKERIWLCIPEMSETKSFLEQILESLIERKIEVERRDIIVKKLQDELGGKKYLLVLDDLWRVDSTSWHEFVDTLRGINTSRGNCILVTTRRKQVASTVATDLHILGKLTEDHCWSIFKQKAFVDGRVPEELASMGNKIVKMCQGLPLAASVLGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVLLDEHNNITHCKMHDLVHDLAGDILKSRLFDPKGDNGEKLSQVRYFGCESPTDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEAQTAYLHDKPNICKLAYLWSHDESEGCEINDEHVLDGLQPHPNLKTLAVVDYLGTKFPSWFSEESLPNLVKLKLSGSKRCKEIPSLGQLKFLRHLELIGFHELECIGPAFYGVEMRNIGSNSIIQVFPSLKKLVLKDMRSLIEWKGDEVGVRMSPGLEKLRITDCPLLKSIPNQFEILRQLKITGVDSEMPLLNLCSNLTSLVKLRVYDMKELTCLPDEMLRNNVSLQQIIIFNCGEFRELPQSLYNLHSLRRLDIYNCTNFSSLPVPNGDNYLTSLEFFCLHNCNGLISIPVGMLDQCRLVFLNVSCCNNLVSFPVHVWEMPSLSYLVISECPKLISVPKVGLHHLTGLVRLGIGPFSEMVDFDAFQLIFNGIQQLLSLRDLEVYGRGHWDSLPYQLMQLSDLREITIADFGIEALPPTLDNLTSLESLTLVRCKQLQHLNFSDAMPKLRLLWIRDCPLLEALSDGLGNLVSLEELYLHDCEKLEHLPSRDAMRRLTKLWNMRIKGCPKLEESFTNYSQWSKISHISNIELGGWRRTAISLGFSFTF

SEQ ID NO: 212 - DNA, 3909 bp, Solanum tarijense
  CDS (1)..(3909)
atgaattattgtcttccttcgagtactctacaaacaactaccaaacgaagacttactttgagaagactttgttgcaaacagctcaggaagaagactttggtgcagactgcagaggaagaggaagcaaacacaactatggccgatgctgtaattggtgctactgttcaagttttgcttgaaaagttgatttctctcactatcgaggacgtcaacagctcaagggatttcaacaaagatctcgaaatgttgacacaaaatgtatctttaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcagtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttcgtaggtgcttctgatgttgttggtagagatttggatgttgctgagataaaggagaagattttgaagatgagagaggaggatgttgttctgtccaccattcccatagtaggtatgggaggtttagggaaaacaactgtggctaagaggatttacaatgatgaacacatgaagcaaatctttaaaaagagaatttggttgtgtctacctgaaatgtctgaaacgaagagctttcttgaacaaatcctcgaatcattgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttctgttagatgaacacaacaatataacacactgcaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcacttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggtcaagttgaaattaagtggtagcaaaaggtgcaaagaaattccatcccttggccaactgaaattccttcggcatcttgagctgataggattccatgagttggaatgcattggacctgctttttatggtgttgagatgagaaatattggatcaaacagcattatccaagtgttcccgtcattgaaaaaactagtattgaaggatatgcgtagccttattgagtggaagggagatgaagttggagtaagaatgtctcccggtcttgagaagttgcggattacagactgtccattgttaaaaagtattccgaatcaatttgaaatcctccgtcaattaaaaattacaggagttgacagtgaaatgccattgttgaacttgtgcagcaacttgacatctctcgtaaagcttagagtctatgatatgaaagagctcacttgtcttccagatgagatgctacgtaacaacgtttctcttcaacagataataattttcaactgcggagagtttcgtgaattgccacaaagcttgtacaatctccattctcttaggagattagacatttacaactgcaccaatttcagttctcttcctgttcccaatggagacaactatttgacttccctcgaattcttttgcttacataattgtaatggattgatcagtataccagttggaatgctagatcaatgccggctagtgtttttgaatgtcagctgctgtaacaacttggtttcattccctgtacatgtgtgggaaatgccttcactttcatatttggttatatcagaatgtcccaaattgattagtgtacccaaagtgggccttcaccatctcaccgggttagtgagattgggaattggtcctttctcagagatggtggattttgatgcattccaattgatttttaatggcattcagcagttgttgtcccttcgtgatctggaggtgtacggacgtgggcactgggattctctgccctatcagcttatgcaactctctgacctaagagagatcacaatagctgatttcggaattgaggctcttcctcctactcttgacaaccttacttctcttgaaagtttgacgctagtgaggtgcaaacagctacaacatctgaacttctcagatgccatgcccaaattacggctcctgtggatacgtgattgtccattgttagaagctctgtcggatgggctcggcaaccttgtttctttggaagaattatatttacatgactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 213 - protein, 1302 aa, Solanum tarijense
MNYCLPSSTLQTTTKRRLTLRRLCCKQLRKKTLVQTAEEEEANTTMADAVIGATVQVLLEKLISLTIEDVNSSRDFNKDLEMLTQNVSLIQAFIHDVETPQEKQQSVEQWLNRLERVAEDAENVFDRFRYESLKTKVVRSPLKKVSGFFSHTAFKRKMSQKINNINKELTAINKVAKDLGLQSLMVPSRKILPIRETDSFVGASDVVGRDLDVAEIKEKILKMREEDVVLSTIPIVGMGGLGKTTVAKRIYNDEHMKQIFKKRIWLCLPEMSETKSFLEQILESLIERKIEVERRDIIVKKLQDELGGKKYLLVLDDLWRVDSTSWHEFVDTLRGINTSRGNCILVTTRRKQVASTVATDLHILGKLTEDHCWSIFKQKAFVDGRVPEELASMGNKIVKMCQGLPLAASVLGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVLLDEHNNITHCKMHDLVHDLAGDILKSRLFDPKGDNGEKLSQVRYFGCESPTDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEAQTAYLHDKPNICKLAYLWSHDESEGCEINDEHVLDGLQPHPNLKTLAVVDYLGTKFPSWFSEESLPNLVKLKLSGSKRCKEIPSLGQLKFLRHLELIGFHELECIGPAFYGVEMRNIGSNSIIQVFPSLKKLVLKDMRSLIEWKGDEVGVRMSPGLEKLRITDCPLLKSIPNQFEILRQLKITGVDSEMPLLNLCSNLTSLVKLRVYDMKELTCLPDEMLRNNVSLQQIIIFNCGEFRELPQSLYNLHSLRRLDIYNCTNFSSLPVPNGDNYLTSLEFFCLHNCNGLISIPVGMLDQCRLVFLNVSCCNNLVSFPVHVWEMPSLSYLVISECPKLISVPKVGLHHLTGLVRLGIGPFSEMVDFDAFQLIFNGIQQLLSLRDLEVYGRGHWDSLPYQLMQLSDLREITIADFGIEALPPTLDNLTSLESLTLVRCKQLQHLNFSDAMPKLRLLWIRDCPLLEALSDGLGNLVSLEELYLHDCEKLEHLPSRDAMRRLTKLWNMRIKGCPKLEESFTNYSQWSKISHISNIELGGWRRTAISLGFSFTF

SEQ ID NO: 214 - DNA, 3909 bp, Solanum chacoense
  CDS (1)..(3909)
atgaattattgtcttccttcgagtactctacaaacaactaccaaacgaagacttactttgagaagactttgttgcaaacagctcaggaagaagactttggtgcagactgcagaggaagaggaagcaaacacaacaatggccgatcctgtaattggtgctactgttcaagttttgcttgaaaagttgatttctctcactatcgaggaagtcaacagctcaagggatttcaacaaagatctcgaaatgttgacacaaaatgtatctttaatccaagctttcattcatgatgttgaaacaccacaagagaaacaacagtctgtggaacaatggctcaacaggcttgagagagttgctgaagatgctcaaaatgtgtttgatcgattcatatatgaatctctcaaaacaaaagtggtgaggagcccattgaaaaaggtcagtggtttcttttctcatactgcttttaagagaaaaatgtctcaaaaaatcaacaacatcaataaagagttgacggctatcaataaggtagccaaagacctcggtctacaatcactcatggttccttctcggaaaatactaccaattcgagaaacagattcctttgtagttgcttctgatattgtcggtagagatttggatattgctgagataaaggagaagattttgaacatgagagaggaggatattgttctgtccaccattcccatagtaggtatgggaggtttagggaaaacaactgtggctaagaggatttacaatgatgaacacatgaagcaaatctttgaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggtgtgttgactctacatcgtggcatgagttcattgacaccttgagaggaataaatacatccagaggaaactgcattcttgtgactactcgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttctgttagatgaacacaacaatataacacactgcaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggtcaagttgaaattaagtggtagcaaaaggtgcaaagaaattccatcccttggccaactgaaattccttcggcatcttgagctgataggattccatgagttggaatgcattggacctgctttttatggtgttgagatgagaaatattggatcaaacagcattatccaagtgttcccgtcattgaaaaaactagtattgaaggatatgcgtagccttattgagtggaagggagatgaagttggagtaagaatgtctcccggtcttgagaagttgcggattacagactgtccattgttaaaaagtattccgaatcaatttgaaatcctccgtcaattaaaaattacaggagttgacagtgaaatgccattgttgaacttgtgcagcaacttgacatctctcgtaaagcttagagtctatgatatgaaagagctcacttgtcttccagatgagatgctacgtaacaacgtttctcttcaacagataataattttcaactgcggagagtttcgtgaattgccacaaagcttgtacaatctccattctcttaggagattagacatttacaactgcaccaatttcagttctcttcctgttcccaatggagacaactatttgacttccctcgaattcttttgcttacataattgtaatggattgatcagtataccaattggaatgctagatcaatgccggctagtgtttttgaatgtcagctgctgtaacaacttggtttcattccctgtacatgtgtgggaaatgccttcactttcatatttgcttatatcagaatgtcccaaattgattagtgtacccaaagtgggccttcaccatctcaccgggttagtgagattgggaattggtcctttctcagagatggtggattttgatgcattccaattgatttttaatggcattcagcagttgttgtcccttcgtgatctggaggtgtacggacgtgggcactgggattctctgccctatcagcttatgcaactctctgacctaagagagatcacaatagctgatttcggaattgaggctcttcctcctactcttgacaaccttacttctcttgaaagtttgacgctagtgaggtgcaaacagctacaacatctgaacttctcagatgccatgcccaaattacggctcctgtggatacgtgattgtccattgttagaagctctgtcggatgggctcggcaaccttgtttctttggaagaattatatttacatgactgcgaaaaactagagcatctaccgtcccgagatgccatgcgacgcctcactaaattatggaacatgagaattaaaggatgcccaaagttagaagaaagtttcaccaactactcccagtggtccaaaatttcccatatttcaaatattgaattaggtgggtggagaaggacagccataagtctcggtttctctttcactttctga

SEQ ID NO: 215 - protein, 1302 aa, Solanum chacoense; identical to SEQ ID NO: 110

SEQ ID NO: 216 - DNA, 3906 bp, Solanum berthaultii
  CDS (1)..(3906)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcagtggtttcttttctcatactgcttttaagagaaaaatgtctcaaaaaatcaacaacatcaataaagagttgacggctatcaataaggtagccaaagacctcggtctacaatcactcatcgtaccttctcggaaaatactaccaattcgagaaacagattccatcgtaggtgcttctgatgttgttggtagagatttggatgttgctgagataaaggagaagattttgaagatgagagaggaggatgttgttttgtccaccattcccatagtaggtatgggaggtttagggaaaacaactgtggctaagaggatttacaatgatgaacacatcaagcaaatctttaaagagagaatttggttgtgtatacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcaacaccctgagaggaataaatacatccagaggaaactgcattcttgtgactactcgtatgaagtgggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgcgttgggagggctcttacacaacaaagaaaaacatgaatggcaagcaattcttgatggcaacctccttgttgcaagtgaagatgataatggagaaaatagcttaaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattgcttgctacaagatgatgtgttagatgaacacaacaatataacacactgcaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagtttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggtcaagttgaaattaagtggtagcaaaaggtgcaaagaaattccatcccttggccaactgaaattccttcggcatcttgagctgataggattccatgagttggaatgcattggacctgctttttatggtgttgagatgagaaatattggatcaaacagcattatccaagtgttcccgtcattgaaaaaactagtattgaaggatatgcgtagccttattgagtggaagggagatgaagttggagtaagaatgtctcccgggcttgagaagttgcggattatagactgtccattgttaaaaagtatcccgaatcaatttgaaatcctccgtcaattagacattagaggagttgacagtgaaatgccattgttgaacttgtgcagcaacttgacatctctcgtaaagcttagtgtctatgatatgaaagagctcacttgtcttccagatgagatgctacgtaacaacgtttctcttcaacagataataattttcaactgcggagagtttcgtgaattgccacaaagcttgtacaatctccattctcttaggagattagacattttcaactgcaccaatttcagttctcttcctgttcccaatggagacaactatttgacttccctcgaattcttttacttatataattgtaatggattgatcagtataccaattggaatgctagatcaatgccggctagtgtttttgaatgtcagctgctgtaacaacttggtttcattccctttacatgtgtgggaaatgccttcattttcagttttgaatataaaagaatgtcccaaattgattagtgtacccaaagtgggccttcaccatctcaccgggttagtgagattgggaattggtcctttctcagagatggtggattttgatgcattccaattgatttttaatggcattcagcagttgtcccttcgtgatctggaggtgtacggacgtgggcactgggattctctgccctatcagcttatgcaactctctgacctaagagagatcacaatagctgatttcggaattgaggctcttcctcctactcttgacaaccttacttctcttgaaagtttgacgctagtgaggtgcaaacagctacaacatctgaacttctcagatgccatgcccaaattacggctcctgtggatacgtgattgtccattgttagaagctctgtcggatgggctcggcaaccttgtttctttggaagaattatatttacatgactgcgaaaaactagagcatctaccgtcccgagatgccatgcgacgcctcactaaattatggaacatgggaattaaaggctgcccaaagttagaagaaagtttcatcaactactcccagtggtccaaaatttcccatatttcagttattgaattaggtgggtggagaaggacaaccgtaagtctcggtttctctttcactttctga

SEQ ID NO: 217 - protein, 1301 aa, Solanum berthaultii
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVSGFFSHTAFKRKMSQKINNINKELTAINKVAKDLGLQSLIVPSRKILPIRETDSIVGASDVVGRDLDVAEIKEKILKMREEDVVLSTIPIVGMGGLGKTTVAKRIYNDEHIKQIFKERIWLCIPEMSETKSFLEQILESLIERKIEVERRDIIVKKLQDELGGKKYLLVLDDLWRVDSTSWHEFVNTLRGINTSRGNCILVTTRMKWVASTVATDLHILGKLTEDHCWSIFKQKAFVDGRVPEELASMGNKIVKMCQGLPLAASALGGLLHNKEKHEWQAILDGNLLVASEDDNGENSLKKILKLSYDYLPSPHLKKCFAYFAMFPKDYMFEKDQLIQLWMAEGFLRPSQEIPVMEDVGHRFFQILLQNCLLQDDVLDEHNNITHCKMHDLVHDLAGDILKSRLFDPKGDNGEKLSQVRYFGCESPTDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEAQTAYLHDKPNICKLAYLWSHDESEGCEINDEHVLDGLQPHPNLKTLAVVDYLGTKFPSWFSEESLPNLVKLKLSGSKRCKEIPSLGQLKFLRHLELIGFHELECIGPAFYGVEMRNIGSNSIIQVFPSLKKLVLKDMRSLIEWKGDEVGVRMSPGLEKLRIIDCPLLKSIPNQFEILRQLDIRGVDSEMPLLNLCSNLTSLVKLSVYDMKELTCLPDEMLRNNVSLQQIIIFNCGEFRELPQSLYNLHSLRRLDIFNCTNFSSLPVPNGDNYLTSLEFFYLYNCNGLISIPIGMLDQCRLVFLNVSCCNNLVSFPLHVWEMPSFSVLNIKECPKLISVPKVGLHHLTGLVRLGIGPFSEMVDFDAFQLIFNGIQQLSLRDLEVYGRGHWDSLPYQLMQLSDLREITIADFGIEALPPTLDNLTSLESLTLVRCKQLQHLNFSDAMPKLRLLWIRDCPLLEALSDGLGNLVSLEELYLHDCEKLEHLPSRDAMRRLTKLWNMGIKGCPKLEESFINYSQWSKISHISVIELGGWRRTTVSLGFSFTF

SEQ ID NO: 218 - DNA, 3900 bp, Solanum berthaultii
  CDS (1)..(3900)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcggtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttagtagttgcttctgatattgtcggtagagatttggatgttgctgagataaaggagaagattttgaagatgagagaggaggatattgttctgtccaccattcccattgtaggtatgggaggtttagggaaaacaactgtggctaagaggatttacaatgatgaacacatgaagcaaatctttaaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcaacaccctgagaggaataaatacatccagaggaaactgcattcttgtgactactcgtatgaagtgggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaagtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgatgtgttagatgaacacaacaatataacacactgcaagatgcacgatcttgtgcatgatttggctggagatatcttaaaatctagactatttgatccgaagggcgacaatggagaaaaactttctcaagttcgatactttggatgtgagtcaccaacggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagcttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtctctaccaaatttggtcaagttgaaattaagtggtagcaaaaggtgcaaagaaattccatcccttggccaactgaaattccttcggcatcttgagctgataggattccacgagttggaatgcattggacctgctttttatggtgttgagattagaaatattggatcaaacagcattatccaagtgttcccgtcattgaaaaaactagtattgacggatatgcgtagccttattgagtggaagggagatgaagttggagtaagaatgtctcccgggcttgagaagttgcggattacagactgtccattgttaaaaagtatcccgaatcaatttgaaatcctccgtcaattagacattagaggagttgacagtgaaataccattgtggaacttgtgcagcaacttgacatctctcgtaaagcttagtgtctatgatatgaaagagctcacttgtcttccagatgagatgctacgtaacaacgtttctcttcaacagataatgattttcgactgtggagagtttcgtgaattgccacaaagcttgtacaatctccattttcttaagagattagaaatttacaactgcaccaatttcagttctcttcctgttcccaatggagacaactatttgacttccctccaattctttcagttatataattgtgatggattgatcagtttaccaattggaatgctagatcaatgccggtctctagagtgtttgtctgtcagctgctgtaacaacttggtttcattccctttacatgtgtgggaaatgccttcactttcatatttggttatatcagaatgtcccaaattgattagtgtacccgaagtgggccttcaccgtctcactgggttattgagattgggaattggtcctttctcagagatggtggattttgatgcattccaattgatttttaatggcattcagcagctgttgtcccttagtgatctggaggtgtatggacatgggcactgggattctctgccctatcagcttatgcaactctctgacctaagagagatccaaatagctgatttcggaattgaggctcttccacctagacttgacaaccttacttctcttgaaagtttgacgctagtgaggtgcaaacggctacaacatctgaacttctcagatgccatgccctcattacggcttctgtggatacgtgattgtccattgttagaagctctgtcggatgatctcggcaaccttgtttctttggaagaattatatttacttgactgcaaaaaactagagggtctaccgtcccgagatgccatgcgacgcctcactaaattatggaacttgggaattaaaggctgcccaaagttaaaagaaacgtggtccaagatttcccatattccaagaattgaatttggtgggatgataattaaggacacatgtaagtgttggtttctctttcactttctgaac

SEQ ID NO: 219 - protein, 1300 aa, Solanum berthaultii
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVGGFFSHTAFKRKMSQKINNINKELTAINKVAKDLGLQSLMVPSRKILPIRETDSLVVASDIVGRDLDVAEIKEKILKMREEDIVLSTIPIVGMGGLGKTTVAKRIYNDEHMKQIFKKRIWLCLPEMSETKSFLEQILESLIERKIEVERRDIIVKKLQDELGGKKYLLVLDDLWRVDSTSWHEFVNTLRGINTSRGNCILVTTRMKWVASTVATDLHILGKLTEDHCWSIFKQKAFVDGRVPEELASMGNKIVKMCQGLPLAASVLGGLLHNKEKHEWQAILDGNLLVASEDDNGENSIKKILKLSYDYLPSPHLKKCFAYFAMFPKDYMFEKDQLIQLWMAEGFLRPSQEIPVMEDVGHRFFQILLQNSLLQDDVLDEHNNITHCKMHDLVHDLAGDILKSRLFDPKGDNGEKLSQVRYFGCESPTDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEAQTAYLHDKPNICKLAYLWSHDESEGCEINDEHVLDGLQPHPNLKTLAVVDYLGTKFPSWFSEESLPNLVKLKLSGSKRCKEIPSLGQLKFLRHLELIGFHELECIGPAFYGVEIRNIGSNSIIQVFPSLKKLVLTDMRSLIEWKGDEVGVRMSPGLEKLRITDCPLLKSIPNQFEILRQLDIRGVDSEIPLWNLCSNLTSLVKLSVYDMKELTCLPDEMLRNNVSLQQIMIFDCGEFRELPQSLYNLHFLKRLEIYNCTNFSSLPVPNGDNYLTSLQFFQLYNCDGLISLPIGMLDQCRSLECLSVSCCNNLVSFPLHVWEMPSLSYLVISECPKLISVPEVGLHRLTGLLRLGIGPFSEMVDFDAFQLIFNGIQQLLSLSDLEVYGHGHWDSLPYQLMQLSDLREIQIADFGIEALPPRLDNLTSLESLTLVRCKRLQHLNFSDAMPSLRLLWIRDCPLLEALSDDLGNLVSLEELYLLDCKKLEGLPSRDAMRRLTKLWNLGIKGCPKLKETWSKISHIPRIEFGGMIIKDTCKCWFLFHFLN

SEQ ID NO: 220 - DNA, 3900 bp, Solanum berthaultii
  CDS (1)..(3900)
  misc_feature (1290)..(1290): The 'Xaa' at location 1290 stands for Cys, or Tyr.
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcggtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttagtagttgcttctgatattgtcggtagagatttggatgttgctgagataaaggagaagattttgaagatgagagaggaggatattgttctgtccaccattcccattgtaggtatgggaggtttagggaaaacaactgtggctaagaggatttacaatgatgaacacatgaagcaaatctttaaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattaggaggaaaaaaatatttgctagtcctggatgatttgtggcgtgttgactctacatcgtggcatgagttcgtcaacaccctgagaggaataaatacatccagaggaaactgcattcttgtgactactcgtatgaagtgggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgtgttgggagggctcttacacaacaaagaaaaacatgaatggcaagcaattcttgatggcaacctccttgttgcaagtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgatgtgttacatgaacacaacaatataacacactgcaagatgcacgatcttgtgcatgatttggctggagatatcttaaaatctagactatttgatccgaagggcgacaatggagaaaaactttctcaagttcgatactttggatgtgagtcaccagcggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagcttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtctctaccaaatttggtcaagttgaaattaagtggtagcaaaaggtgcaaagaaattccatcccttggccaactgaaattccttcggcatcttgagctgataggattccacgagttggaatgcattggacctgctttttatggtgttgagattagaaatattggatcaaacagcattatccaagtgttcccgtcattgaaaaaactagtattgacggatatgcgtagccttattgagtggaagggagatgaagttggagtaagaatgtctcccgggcttgagaagttgcggattacagactgtccattgttaaaaagtatcccgaatcaatttgaaatcctccgtcaattagacattagaggagttgacagtgaaataccattgttgaacttgtgcagcaacttgacatctctcgtaaagcttagtgtctatgatatgaaagagctcacttgtcttccagatgagatgctacgtaacaacgtttctcttcaacagataatgattttcgactgcggagagtttcgtgaattgccacaaagcttgtacaatctccattttcttaagagattagaaatttacaactgcaccaatttcagttctcttcctgttcccaatggagacaactatttgacttccctccaattctttcagttatataattgtgatggattgatcagtttaccaattggaatgctagatcaatgccggtctctagagtgtttgtctgtcagctgctgtaacaacttggtttcattccctttacatgtgtgggaaatgccttcactttcatatttggttatatcagaatgtcccaaattgattagtgtacccgaagtgggccttcaccgtctcactgggttattgagattgggaattggtcctttctcagagatggtggattttgatgcattccaattgatttttaatggcattcagcagctgttgtcccttagtgatctggaggtgtatggacatgggcactgggattctctgccctatcagcttatgcaactctctgacctaagagagatccaaatagctgatttcggaattgaggctcttccacctagacttgacaaccttacttctcttgaaagtttgacgctagtgaggtgcaaacggctacaacatctgaacttctcagatgccatgccctcattacggcttctgtggatacgtgattgtccattgttagaagctctgtcggatgatctcggcaaccttgtttctttggaagaattatatttacttgactgcaaaaaactagagggtctaccgtcccgagatgccatgcgacgcctcactaaattatggaacttgggaattaaaggctgcccaaagttaaaagaaacgtggtccaagatttcccatattccaagaattgaatttggtgggatgataattaaggacacatrtaagtgttggtttctctttcactttctgaac

SEQ ID NO: 221 - protein, 1300 aa, Solanum berthaultii
  misc_feature (1290)..(1290): The 'Xaa' at location 1290 stands for Cys, or Tyr.
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVGGFFSHTAFKRKMSQKINNINKELTAINKVAKDLGLQSLMVPSRKILPIRETDSLVVASDIVGRDLDVAEIKEKILKMREEDIVLSTIPIVGMGGLGKTTVAKRIYNDEHMKQIFKKRIWLCLPEMSETKSFLEQILESLIERKIEVERRDIIVKKLQDELGGKKYLLVLDDLWRVDSTSWHEFVNTLRGINTSRGNCILVTTRMKWVASTVATDLHILGKLTEDHCWSIFKQKAFVDGRVPEELASMGNKIVKMCQGLPLAASVLGGLLHNKEKHEWQAILDGNLLVASEDDNGENSIKKILKLSYDYLPSPHLKKCFAYFAMFPKDYMFEKDQLIQLWMAEGFLRPSQEIPVMEDVGHRFFQILLQNSLLQDDVLHEHNNITHCKMHDLVHDLAGDILKSRLFDPKGDNGEKLSQVRYFGCESPADQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEAQTAYLHDKPNICKLAYLWSHDESEGCEINDEHVLDGLQPHPNLKTLAVVDYLGTKFPSWFSEESLPNLVKLKLSGSKRCKEIPSLGQLKFLRHLELIGFHELECIGPAFYGVEIRNIGSNSIIQVFPSLKKLVLTDMRSLIEWKGDEVGVRMSPGLEKLRITDCPLLKSIPNQFEILRQLDIRGVDSEIPLLNLCSNLTSLVKLSVYDMKELTCLPDEMLRNNVSLQQIMIFDCGEFRELPQSLYNLHFLKRLEIYNCTNFSSLPVPNGDNYLTSLQFFQLYNCDGLISLPIGMLDQCRSLECLSVSCCNNLVSFPLHVWEMPSLSYLVISECPKLISVPEVGLHRLTGLLRLGIGPFSEMVDFDAFQLIFNGIQQLLSLSDLEVYGHGHWDSLPYQLMQLSDLREIQIADFGIEALPPRLDNLTSLESLTLVRCKRLQHLNFSDAMPSLRLLWIRDCPLLEALSDDLGNLVSLEELYLLDCKKLEGLPSRDAMRRLTKLWNLGIKGCPKLKETWSKISHIPRIEFGGMIIKDTXKCWFLFHFLN

SEQ ID NO: 222 - DNA, 3900 bp, Solanum berthaultii
  CDS (1)..(3900)
atgaattattgtcttccttcgagtactctacaaacaactaccaaacgaagacttactttgagaagactttgttgcaaacagctcaggaagaagactttggtgcagattgcagaggaagaggaagcaaacacaactatggccgatgctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacactggctcaacaggcttgagagagttgctgaagatgctgaaaatgtgtttgatcgattcagatatgaatctctcaaaacaaaagtggtgaggagcccattgaaaaaggtcagtggtttcttttctcatactgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttcgtaggtgcttctgatgttgttggtagagatttagatgttgctgagataaaggagaagattttgaagatgagagaggaggatgttgttctgtccaccattcccatagtaggtatgggaggtttagggaaaacaactgtggctaagaggatttacaatgatgaacacatcaagcaaatctttaaagagagaatttggttgtgtatacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactactcgtatgaagcgggtggcatccacagtagcaacagatcttcatatcttggggaagttaacagaagatcattgttggtctattttcaaacaaaaagcatttgttgatggcagggttccagaggaattagcgagcatgggcaacactattgttaaaatgtgccaaggtctaccgttggctgcaagtgcattgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaacaatgctttgcttactttgcaatgtttccaaaagattatatgtttgaaaaggaccaactaatccaactctggatggcagaagggtttcttcgtccaagtcaagagatccctgtgatggaagacgttgggcacaggttttttcaaatcttgttgcagaattccttgctacaagatgttgtgttagatgaacacaacaatataacacactgtaagatgcacgatcttgtgcatgatttggctggagatatcttaaaatctagactatttgatccgaagggcgacaatggagaaaaactttctcaagttcgatactttggatgtgagtcaccaaaggatcaaatagataagatatatgagccagaacgtttgtgcacactgttttggagaagcaattatacatctaaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccaggaacttccatatgagatgagaaatatgataagcttgagacacatatattacacttctgttgacgaaacaagtgggcattggggaggatggtgtcttcacaatgaacattttcagattccacttaatatggggcaattgactagtcttcaaaccctcaagtttttcaaggtaggtttagagaaaggtcgtcaaatagaagaattaggtcatttgaaaaacctaagaggtgaattgacgatcaatggtctccaattggtctgtgataaagaagaggctcaaacagcatatttacacgataaaccaaacatctgcaagctggcatatttatggtcccatgatgaatcagaaggctgtgagatcaatgatgagcatgtgttggatggtcttcaaccgcatcctaacttgaaaaccttagcagtagtggactatttagggactaaatttccttcatggttcagtgaagagtctctaccaaatttggtcaagttgaaattaagtggtagcaaaaggtgcaaagaaattccatcccttggccaactgaaattccttcggcatcttgagctgataggattccacgagttggaatgcattggacctgctttttatggtgttgagattagaaatattggatcaaacagcattatccaagtgttcccgtcattgaaaaaactagtattgacggatatgcgtagccttattgagtggaagggagatgaagttggagtaagaatgtctcccgggcttgagaagttgcggattacagactgtccattgttaaaaagtatcccgaatcaatttgaaatcctccgtcaattagacattagaggagttgacagtgaaataccattgttgaacttgtgcagcaacttgacatctctcgtaaagcttagtgtctatgatatgaaagagctcacttgtcttccagatgagatgctacgtaacaacgtttctcttcaacagataatgattttcgactgtggagagtttcgtgaattgccacaaagcttgtacaatctccattttcttaagagattagaaatttacaactgcaccaatttcagttctcttcctgttcccaatggagacaactatttgacttccctccaattctttcagttatataattgtgatggattgatcagtttaccaattggaatgctagatcaatgccggtctctagagtgtttgtctgtcagctgctgtaacaacttggtttcattccctttacatgtgtgggaaatgccttcactttcatatttggttatatcagaatgtcccaaattgattagtgtacccgaagtgggccttcaccgtctcactgggttattgagattgggaattggtcctttctcagagatggtggattttgatgcattccaattgatttttaatggcattcagcagctgttgtcccttagtgatctggaggtgtatggacatgggcactgggattctctgccctatcagcttatgcaactctctgacctaagagagatccaaatagctgatttcggaattgaggctcttccacctagacttgacaaccttacttctcttgaaagtttgacgctagtgaggtgcaaacggctacaacatctgaacttctcagatgccatgccctcattacggcttctgtggatacgtgattgtccattgttagaagctctgtcggatgatctcggcaaccttgtttctttggaagaattatatttacttgactgcaaaaaactagagggtctaccgtcccgagatgccatgcgacgcctcactaaattatggaacttgggaattaaaggctgcccaaagttaaaagaaacgtggtccaagatttcccatattccaagaattgaatttggtgggatgataattaaggacacatgtaagtgttggtttctctttcactttctgaac

SEQ ID NO: 223 - protein, 1300 aa, Solanum berthaultii
MNYCLPSSTLQTTTKRRLTLRRLCCKQLRKKTLVQIAEEEEANTTMADAVIGATVQVLLEKLISLTIEEVNSSRDFNKDLEMLTQNVSLIQAFIHDVETPQEKQQSVEHWLNRLERVAEDAENVFDRFRYESLKTKVVRSPLKKVSGFFSHTAFKRKMSQKINNINKELTAINKVAKDLGLQSLMVPSRKILPIRETDSFVGASDVVGRDLDVAEIKEKILKMREEDVVLSTIPIVGMGGLGKTTVAKRIYNDEHIKQIFKERIWLCIPEMSETKSFLEQILESLIERKIEVERRDIIVKKLQDELGGKKYLLVLDDLWRVDSTSWHEFVDTLRGINTSRGNCILVTTRMKRVASTVATDLHILGKLTEDHCWSIFKQKAFVDGRVPEELASMGNTIVKMCQGLPLAASALGGLLHNKEKHEWQAILDGNLLVAGEDDNGENSIKKILKLSYDYLPSPHLKQCFAYFAMFPKDYMFEKDQLIQLWMAEGFLRPSQEIPVMEDVGHRFFQILLQNSLLQDVVLDEHNNITHCKMHDLVHDLAGDILKSRLFDPKGDNGEKLSQVRYFGCESPKDQIDKIYEPERLCTLFWRSNYTSKDMLLNFKFLRVLDLSSSGIKELSAKIGKLIYLRYLDLSNTEITALPNSICKLYNLQTFRVINCFSLQELPYEMRNMISLRHIYYTSVDETSGHWGGWCLHNEHFQIPLNMGQLTSLQTLKFFKVGLEKGRQIEELGHLKNLRGELTINGLQLVCDKEEAQTAYLHDKPNICKLAYLWSHDESEGCEINDEHVLDGLQPHPNLKTLAVVDYLGTKFPSWFSEESLPNLVKLKLSGSKRCKEIPSLGQLKFLRHLELIGFHELECIGPAFYGVEIRNIGSNSIIQVFPSLKKLVLTDMRSLIEWKGDEVGVRMSPGLEKLRITDCPLLKSIPNQFEILRQLDIRGVDSEIPLLNLCSNLTSLVKLSVYDMKELTCLPDEMLRNNVSLQQIMIFDCGEFRELPQSLYNLHFLKRLEIYNCTNFSSLPVPNGDNYLTSLQFFQLYNCDGLISLPIGMLDQCRSLECLSVSCCNNLVSFPLHVWEMPSLSYLVISECPKLISVPEVGLHRLTGLLRLGIGPFSEMVDFDAFQLIFNGIQQLLSLSDLEVYGHGHWDSLPYQLMQLSDLREIQIADFGIEALPPRLDNLTSLESLTLVRCKRLQHLNFSDAMPSLRLLWIRDCPLLEALSDDLGNLVSLEELYLLDCKKLEGLPSRDAMRRLTKLWNLGIKGCPKLKETWSKISHIPRIEFGGMIIKDTCKCWFLFHFLN

SEQ ID NO: 224 - DNA, 3912 bp, Solanum berthaultii
  CDS (1)..(3912)
atgaattattgtcttccttcgagtactctacaaacaactaccaaacgaagacttactttgagaagactttgttgcaaacagctcaggaagaagactttggtgcagactgcagaggaagaggaagcaaacacaactatggccgatcctgtaattggtgctactgttcaagttttgcttgaaaagttgatttctctcactatcgaggaggtcaacagctcaagggatttcaacaaagatctcgaaatgttgacacaaaatgtatctttaatccaagctttcattcatgatgttgaaacaccacaagagaaacaacagtctgtcgaacaatggctcaacaggcttgagagagttgctgaagatgctgaaaatgtgtttgatcgattcagatatgaatctctcaaaacaaaagtggtgaggagcccattgaaaaaggtcggtggtttcttttctcatattgcttttaagagaaaaatgtctcaaaaaatcaacaacatcaataaagagttgacggctatcaataaggtagccaaagacctcggtctacaatcactcatggtaccttctcggaaaatactaccaattcgagaaacagattccttagtagttgcttctgatattgtcggtagagatttggatgttgctgagataaaggagaagattttgaagatgagagaggaggatattgttctgtccaccattcccattgtaggtatgggaggtttagggaaaacaactgtggctaagaggatttacaatgatgaacacatgaagcaaatctttaaaaagagaatttggttgtgtctacctgaaatgtctgaaacgaagagctttcttgaacaaatcctcgaatcgttgatagagaggaaaattgaggttgaaaggagagatataatagtcaagaagctacaagatgaattgggaggaaaaaaatatttgctagtcctggatgatttgtggcgtgttgactctacatcgtggcatgagttcgtcgacaccctgagaggaataaatacatccagaggaaactgcattcttgtgactacttgtaggaagcaggtggcatccacagtagcaacagatcttcatatcttggggaagttaacagaagatcattgttggtctattttcaaacaaaaagcatttgttgatggcagggttccagaggaattagcgagcatgggcaacaagattgttaaaatgtgccaaggtctaccgttggctgcaagtgcgttgggagggctcttacacaacaaagaaaaacatgaatggcaagcaattcttgatggcaacctccttgttgcaggtgaagatgataatggagaaaatagcataaagaaaatcctaaaactcagctatgattatctaccatctccacatctgaaaaaatgctttgcttactttgcaatgtttccaaaagattatatgtttgaaaaggaccaactaatccaactctggatggcagaaggatttcttcgtccaagtcaagagatccctgtgatggaagacgttgggcacaggttttttcaaatcttgttgcagaattccttgctacaagatgttgtgttagatgaacacaacaatataacacactgtaagatgcacgatcttgtgcatgatttggctggagatatcttaaaatctagactatttgatccgaagggcgacgatggagaaaaactttctcaagttcgatactttggatgtgagtcaccaacggatcaaatagataagatatatgagccagaacgtttgtgcacactgttttggagaagcaattatacatctgaagatatgctgttgaactttaagttcttgagagttttagatttgtccagttcaggaatcaaggagttgtcagccaaaatcgggaagctgatatacttgagatatcttgatctctcgaacactgagatcacagccttgcccaactccatttgcaagctctataatttgcaaacatttagagtcatcaactgcttttcactccagaaacttccatatgagatgggaaatatggtaagtttgagacacatatattacacttctgttgacaaaagaaatgagcattggggaggatggtgtattctcaatgaacgttttcagatgccacttaagatgcgacaattaacttgtcttcaaaccctcaagtttttcaagataggtttaaagaaaggtcgtcaaatagaagaattaggtcatttgaaaaacctaagaggtgaattgacgatcaatggtctccaattggtctgtgataaagaagaggctcgaacagcatatttacacgataaaccaaacatcttcaagctggcatttttatggtcccacgatgaatcagaaggctgtgagatcaatgatgagcatgtgttggatggtcttcaaccgcatcctaacttgaaaaccttagcagtagtggactatttagggactaaatttccttcatggttcagtgaagagtcgctaccaaatttggttaagttgaaattaagtggtagcaaaaggtgcaaagaaattccatcccttggccaactgaaattccttcggcatcttgagctgataggattccatgagttggaatgcattggacctgctttatatggtgttgagattagaaatattggatcaaacagcattatccaagtgttcccgtcattgaaagaactagtattggaggatatgcgtagccttattgagtggaagggagatgaagttggagtaagaatgtttcctaggcttgagaagttgaggattatggagtgtccattgttaaaaagtactccaagtcaatttgaaagcctgcgtgaattagacattgtcacagttgacagtgaaatgccattgttgaacttgtgcagcaacttaacatctctcgtagagcttagcgtctttgctgtgaaagagctcacttgtttacccgatgagatgctacgcaacaacgtttctcttcaacagataacgattttcaactgcggagagtttcgtgaattgccacaaagcttgtacaatctccattctctgaggaaattaggcatttacaactgcaccaatttcagttctcttcctgttcccaatggagacaactatttgacttccctccaactctttttcttatataattgtaatggattgatcagtataccaattggaatgctagatcaatgccggtctctagagtttttgaatgtcagctgctgtaacaacttggtttcattccctttacgtgtgtgggaaatgccttcattattatttttggatataacagaatgtcccaaattgattagtgtacccaaagtgggccttcaccatctcactgggttattgagattgggaattggtcctttctcaaagatggtggattttgatgcattccaattgatttttaatggcattcagcagctgttgtcccttcgtgatctggaggtgtacggacgtgggcactgggattctctgccctatcagattatgcaactatctgacctaagagagatcacaatagctgattttggaattgaggctcttcctcctagacttgacaaccttacttctcttgaaagcttgactctagtgaggtgcaaacagctacaacatctgaacttctcagatgccatgcccaaattacggctcctgtggatacgtgattttccattgttagaagctctgtcagatgggctcggcaaccttgtttctttggaagaattatatttacatgactgcgaaaaactagagcatctaccgtcccgagatgccatgcgatgcctcactaaattatggaacatgggaattaaaggctgcccaaagttagaagaaagttacaccaactactcccagtggtccaaaatttcccatatttcaaatattgaattaggtgggaggagaagtacagccgtaagtctcggtttctctttcactttctga

SEQ ID NO: 225 - protein, 1303 aa, Solanum berthaultii
MNYCLPSSTLQTTTKRRLTLRRLCCKQLRKKTLVQTAEEEEANTTMADPVIGATVQVLLEKLISLTIEEVNSSRDFNKDLEMLTQNVSLIQAFIHDVETPQEKQQSVEQWLNRLERVAEDAENVFDRFRYESLKTKVVRSPLKKVGGFFSHIAFKRKMSQKINNINKELTAINKVAKDLGLQSLMVPSRKILPIRETDSLVVASDIVGRDLDVAEIKEKILKMREEDIVLSTIPIVGMGGLGKTTVAKRIYNDEHMKQIFKKRIWLCLPEMSETKSFLEQILESLIERKIEVERRDIIVKKLQDELGGKKYLLVLDDLWRVDSTSWHEFVDTLRGINTSRGNCILVTTCRKQVASTVATDLHILGKLTEDHCWSIFKQKAFVDGRVPEELASMGNKIVKMCQGLPLAASALGGLLHNKEKHEWQAILDGNLLVAGEDDNGENSIKKILKLSYDYLPSPHLKKCFAYFAMFPKDYMFEKDQLIQLWMAEGFLRPSQEIPVMEDVGHRFFQILLQNSLLQDVVLDEHNNITHCKMHDLVHDLAGDILKSRLFDPKGDDGEKLSQVRYFGCESPTDQIDKIYEPERLCTLFWRSNYTSEDMLLNFKFLRVLDLSSSGIKELSAKIGKLIYLRYLDLSNTEITALPNSICKLYNLQTFRVINCFSLQKLPYEMGNMVSLRHIYYTSVDKRNEHWGGWCILNERFQMPLKMRQLTCLQTLKFFKIGLKKGRQIEELGHLKNLRGELTINGLQLVCDKEEARTAYLHDKPNIFKLAFLWSHDESEGCEINDEHVLDGLQPHPNLKTLAVVDYLGTKFPSWFSEESLPNLVKLKLSGSKRCKEIPSLGQLKFLRHLELIGFHELECIGPALYGVEIRNIGSNSIIQVFPSLKELVLEDMRSLIEWKGDEVGVRMFPRLEKLRIMECPLLKSTPSQFESLRELDIVTVDSEMPLLNLCSNLTSLVELSVFAVKELTCLPDEMLRNNVSLQQITIFNCGEFRELPQSLYNLHSLRKLGIYNCTNFSSLPVPNGDNYLTSLQLFFLYNCNGLISIPIGMLDQCRSLEFLNVSCCNNLVSFPLRVWEMPSLLFLDITECPKLISVPKVGLHHLTGLLRLGIGPFSKMVDFDAFQLIFNGIQQLLSLRDLEVYGRGHWDSLPYQIMQLSDLREITIADFGIEALPPRLDNLTSLESLTLVRCKQLQHLNFSDAMPKLRLLWIRDFPLLEALSDGLGNLVSLEELYLHDCEKLEHLPSRDAMRCLTKLWNMGIKGCPKLEESYTNYSQWSKISHISNIELGGRRSTAVSLGFSFTF

The invention claimed is:

1. A method for increasing resistance in a *Solanaceae* plant against infection by *Phytophthora infestans*, said method comprising introducing into said plant or a part thereof a nucleic acid that expresses a nucleotide sequence encoding a protein of the amino acid sequence SEQ ID NO:126 or a homolog thereof;

wherein the homolog is a protein having an amino acid sequence selected from the group consisting of SEQ ID NO:194; SEQ ID NO:198; SEQ ID NO:203; SEQ ID NO:205; SEQ ID NO:207; SEQ ID NO:209; SEQ ID NO:211; SEQ ID NO:217; SEQ ID NO:219; SEQ ID NO:221; and SEQ ID NO:223; and which homolog confers resistance to *P. infestans* in *Solanaceae*in a detached leaf assay;

wherein said plant exhibits increased resistance to said infection as compared to a plant into which said nucleic acid has not been introduced.

2. The method of claim 1, wherein the encoding nucleotide sequence comprises SEQ ID NO:125; SEQ ID NO:193; SEQ ID NO:197; SEQ ID NO:202; SEQ ID NO:204; SEQ ID NO:206; SEQ ID NO:208; SEQ ID NO:210; SEQ ID NO:216; SEQ ID NO:218; SEQ ID NO:220; or SEQ ID NO:222.

3. A method for breeding a *P. infestans*-resistant plant, comprising a) increasing the ploidy level of gametes of a diploid *Solanaceae* plant that already contains the nucleic acid as it is defined in the method of claim 1;

b) crossing said gametes with gametes of a *Solanaceae* tetraploid plant; and c) selecting offspring of said cross for the presence of said nucleic acid, wherein offspring that exhibit the presence of said nucleic acid exhibit resistance to *P. infestans* in a detached leaf assay.

4. The method of claim 3, wherein the diploid plant of step a) is *S. chacoense, S. berthaultii, S. sucrense*, or *S. tarijense*.

5. A method for determining whether a *Solanaceae* plant, plant part, or progeny of a plant is susceptible or resistant to *P. infestans* infection, said method comprising the steps of testing said plant or plant part or progeny for the presence or absence of the nucleic acid as it is defined in the method of claim 1, wherein the presence of said nucleic acid indicates said plant, plant part or progeny is resistant to *P. infestans* infection and the absence of said nucleic acid indicates said plant, plant part or progeny is susceptible to *P. infestans* infection;

wherein said testing comprises detecting the presence of one or more amplification products obtained using a primer pair of Table 2.

6. A recombinant cloning vector that is modified to include an encoding nucleotide sequence encoding the amino acid sequence SEQ ID NO:126 or a homolog thereof, [or to include an encoding nucleotide sequence encoding a homolog] wherein the homolog is a protein having an amino acid sequence selected from the group consisting of: SEQ ID NO:194; SEQ ID NO:198; SEQ ID NO:203; SEQ ID NO:205; SEQ ID NO:207; SEQ ID NO:209; SEQ ID NO:211; SEQ IDD NO:217; SEQ ID NO:219; SEQ ID NO:221; and SEQ ID NO:223, and which homolog confers resistance to *P. infestans* in *Solanaceae* in a detached leaf assay.

7. The recombinant cloning vector of claim 6 wherein said encoding nucleotide sequence is selected from the group consisting of SEQ ID NO:125; SEQ ID NO:193; SEQ ID NO:197; SEQ ID NO:202; SEQ ID NO:204; SEQ ID NO:206; SEQ ID NO:208; SEQ ID NO:210; SEQ ID NO:216; SEQ ID NO:218; SEQ ID NO:220; and SEQ ID NO:222.

8. A transgenic or tetraploid *Solanaceae* cell comprising the recombinant cloning vector of claim 6.

9. A transgenic or tetraploid *Solanaceae* [tetraploid] plant comprising the cell of claim 8.

10. A plant part from a transgenic or tetraploid *Solanaceae* [tetraploid] plant comprising the recombinant cloning vector of claim 6.

11. The cell of claim 8 which is *Solanum tuberosum*.

12. The method of claim 5 which further comprises contacting the amplification product with the corresponding CAPS restriction enzyme set forth in Table 2.

* * * * *